US010959413B2

(12) United States Patent
Church et al.

(10) Patent No.: US 10,959,413 B2
(45) Date of Patent: *Mar. 30, 2021

(54) MULTIPLEXED GENOME EDITING

(71) Applicant: President and Fellows of Harvard College, Cambridge, MA (US)

(72) Inventors: George M. Church, Brookline, MA (US); Luhan Yang, Somerville, MA (US); Marc Guell, Barcelona (ES)

(73) Assignee: President and Fellows of Harvard College, Cambridge, MA (US)

(*) Notice: Subject to any disclaimer, the term of this patent is extended or adjusted under 35 U.S.C. 154(b) by 0 days.

This patent is subject to a terminal disclaimer.

(21) Appl. No.: 15/766,551

(22) PCT Filed: Oct. 7, 2016

(86) PCT No.: PCT/US2016/055916
§ 371 (c)(1),
(2) Date: Apr. 6, 2018

(87) PCT Pub. No.: WO2017/062723
PCT Pub. Date: Apr. 13, 2017

(65) Prior Publication Data
US 2018/0288983 A1    Oct. 11, 2018

Related U.S. Application Data

(60) Provisional application No. 62/239,239, filed on Oct. 8, 2015.

(51) Int. Cl.
| C12N 15/63 | (2006.01) |
| C07H 21/02 | (2006.01) |
| C07H 21/04 | (2006.01) |
| A01K 67/027 | (2006.01) |
| C12N 15/113 | (2010.01) |
| C12N 15/85 | (2006.01) |
| C12N 7/00 | (2006.01) |
| C12N 9/22 | (2006.01) |
| C12N 15/11 | (2006.01) |
| C12N 15/90 | (2006.01) |

(52) U.S. Cl.
CPC ...... *A01K 67/0275* (2013.01); *A01K 67/0273* (2013.01); *A01K 67/0276* (2013.01); *C12N 7/00* (2013.01); *C12N 9/22* (2013.01); *C12N 15/11* (2013.01); *C12N 15/1132* (2013.01); *C12N 15/63* (2013.01); *C12N 15/85* (2013.01); *C12N 15/8509* (2013.01); *C12N 15/907* (2013.01); *A01K 2207/05* (2013.01); *A01K 2207/10* (2013.01); *A01K 2227/108* (2013.01); *A01K 2267/025* (2013.01); *C07H 21/02* (2013.01); *C07H 21/04* (2013.01); *C12N 2310/20* (2017.05); *C12N 2740/10062* (2013.01); *C12N 2800/80* (2013.01)

(58) Field of Classification Search
CPC .... C12N 15/63; C12N 2310/20; C07H 21/02; C07H 21/04
USPC ................................ 435/455; 536/23.1, 23.7
See application file for complete search history.

(56) References Cited

U.S. PATENT DOCUMENTS

| 2005/0216964 A1 | 9/2005 | Patience |
| 2005/0266561 A1 | 12/2005 | Wells |
| 2015/0232833 A1 | 8/2015 | Mali et al. |
| 2016/0208243 A1 | 7/2016 | Zhang et al. |
| 2018/0073019 A1 | 3/2018 | Khalili |

FOREIGN PATENT DOCUMENTS

| CN | 105154471 A | 12/2015 |
| EP | 1582591 A2 | 10/2005 |
| WO | 2014/093701 A1 | 6/2014 |
| WO | 2015031775 A1 | 3/2015 |
| WO | 2015/089465 A1 | 6/2015 |
| WO | 2017109177 A1 | 6/2017 |
| WO | 2018144546 A1 | 8/2018 |
| WO | 2018195402 A1 | 10/2018 |

OTHER PUBLICATIONS

Borner et al., Oct. 2014, human Gene therapy, vol. 25, No. 11, pp. A24, Abstract No. OR001.*
Gersbach et al., 2016, US 20160201089 A1, effective filed, Jun. 5, 2013.*
Kaminski et al., Jul. 19, 2015, Journal of the International AIDS Society, vol. 18, Supp. Suppl. 4, pp. 33, Abstract No. TUAA0203.*
Dieckhoff, et al. "Knockdown of porcine endogenous retrovirus (PERV) expression by PE RV-specific sh RNA in transgenic pigs" (Xenotransplantation, vol. 15 No. 1, 2008: pp. 36-45). (Year 2008).
Ericsson, et al (Journal of Virology, Mar. 2001: vol. 75, No. 6, pp. 2765-2770) (Year: 2001).
Fang, et al in "The sequence and analysis of a Chinese pig genome" (GigaScience vol. 1, No. 1, Dec. 1, 2012, pp. 1-11). (Year: 2012).
Karlas, et al (Virology 2004: vol. 325, pp. 18-23). (Year: 2004).
STIC result for Klymiuk et al in J. Gen. Viral. vol. 87, No. 4, pp. 977-986 published Apr. 2006) (Year: 2006).
Semaan, et al in Cytotoxic Effects during Knock Out of Multiple Porcine Endogenous Retrovirus (PERV) Sequences in The Pig Genome by Zinc Finger Nucleases (ZFN) (PLOS ONE published Apr. 24, 2015) (Year: 2015).

(Continued)

*Primary Examiner* — Shin Lin Chen
(74) *Attorney, Agent, or Firm* — Banner & Witcoff, Ltd.

(57) ABSTRACT

A method of modulating some or all copies of a gene in a cell is provided including introducing into a cell one or more ribonucleic acid (RNA) sequences that comprise a portion that is complementary to all or a portion of each of the one or more target nucleic acid sequences, and a nucleic acid sequence that encodes a Cas protein and maintaining the cells under conditions in which the Cas protein is expressed and the Cas protein binds and modulates the one or more target nucleic acid sequences in the cell.

8 Claims, 41 Drawing Sheets

Specification includes a Sequence Listing.

(56) References Cited

OTHER PUBLICATIONS

Semaan, et al in "Long-term effects of PE RV-specific RNA interference in transgenic pigs" (Abstract only of: Xenotransplantation 2012 vol. 19, pp. 112-121). (Year 2012).
Dunn et al., Apr. 1, 2015, FASEB Journal, vol. 29, No. 1_Supplement, Abstract No. LB761.
Third Party Observation filed in PCT/US2016/055916 on Feb. 7, 2018.
Butler et al. "Recent advances in genome editing and creation of genetically modified pigs," International Journal of Surgery, Jul. 29, 2015 (Jul. 29, 2015), vol. 23, Pt. B, pp. 217-222.
Denner, Joachim: "Elimination of porcine endogenous retroviruses from pig cells", Xenotransplantation, Nov. 1, 2015 (Nov. 1, 2015), pp. 411-412, XP055576316, Denmark DOI:10.1111/xen.12210 Retrieved from the internet: URL: file:///C:\Users\FC02424\AppData\Roaming\Mozilla\Firefox\Profiles\FC02424\CiteNPLTemp\CiteNPLWebPage/pdf [retrieved on Apr. 1, 2019].
Niu, Dong et al. "Inactivation of porcine endogenous retrovirus in pigs using CRISPR-Cas9", Science, vol. 357, No. 6357, Aug. 10, 2017 (Aug. 10, 2017), pp. 1303-1307, XP055549027, US ISSN: 0036-8075, DOI: 10.1126/science.aan4187.
Yang, Luhan et al. "Genome-wide inactivation of porcine endogenous retroviruses (PERVs)" Science, Nov. 27PUB Inv, vol. 350, No. 6264, Oct. 11, 2015 (Oct. 11, 2015), pp. 1101-1104, XP055372260, US ISSN: 0036-8075, DOI: 10.1126/science.aad1191.
USPTO, Final Office Action for U.S. Appl. No. 15/888,581. dated Dec. 14, 2018. 19 pages.
USPTO, Notice of Allowance for U.S. Appl. No. 15/888,581. dated Apr. 3, 2019. 7 pages.
EPO, Extended European Search Report for European Patent Application No. 16854392.4. dated Apr. 11, 2019. 13 pages.
Li et al., "Knockdown of Porcine Endogenous Retroviruses by RNA Interference in Chinese Experimental Miniature Pig Fibroblasts," Transplantation Proceedings, vol. 45, No. 2, pp. 748-755 (2013).
Chung et al., "Inhibition of porcine endogenous retrovirus in PK15 cell line by efficient multitargeting RNA interference," Transpl. Int., vol. 27, No. 1, pp. 96-105 (2014).

* cited by examiner

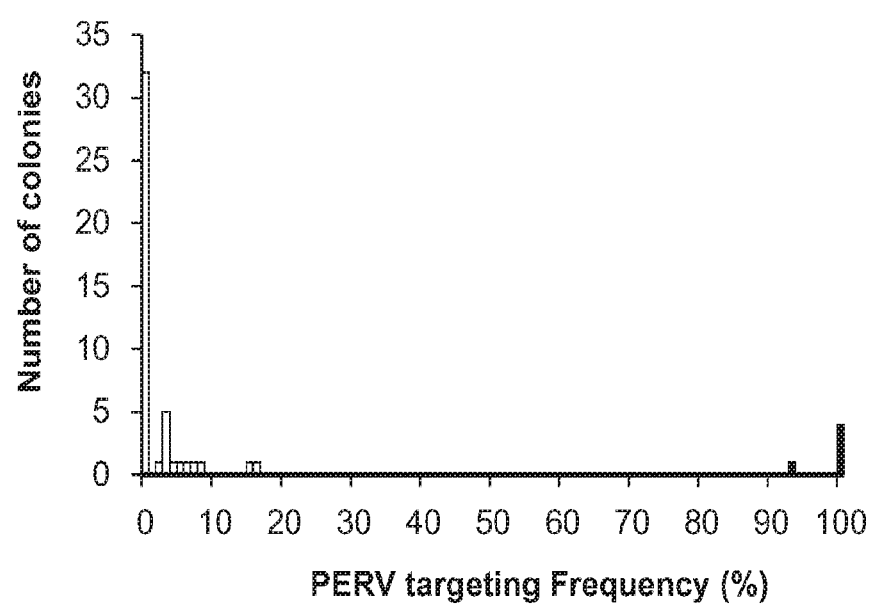

5' GGACCTGGCCAACTTCAGGATCCAAACACCCTCAGGTGACCCTCCT-CCAG-TACGTGGATGACCTGCTTCTGGCGGGAGCCAC 3'
5' GGACC-----A-C----AG-A-----------G---A-------CCAG-TACGTGGATGACCTGCTTCTGGCGGGAGCCAC 3'
5' GGACCTGGCCAACTTCAGGATCCA-------------G-------ACGTGGATGACCTGCTTCTGGCGGGAGCCAC 3'
5' GGACCTGGCCAACTTCAGGATCCAAACACCCTCAGG-------T------G-T-----TGGATGACCTGCTTCTGGCGGGAGCCAC 3'
5' GGACCTGGCCAACTTCAGGATCCAAACACCCTCAGGTGACCCTCCT-CCA-------TGGATGACCTGCTTCTGGCGGGAGCCAC 3'
5' GGACCTGGCCAACTTCAGGATCCAAACACCCTCAGGTGAC---CCT-CCAG-TACGTGGATGACCTGCTTCTGGCGGGAGCCAC 3'
5' GGACCTGGCCAACTTCAGGATCCAAACACCCTCAGGTGACCCTCCT-CCAGTTACGTGGATGACCTGCTTCTGGCGGGAGCCAC 3'
5' GGACCTGGCCAACTTCAGGATCCAAACACCCTCAGGTGACCCTCCTCCCAG-TACGTGGATGACCTGCTTCTGGCGGGAGCCAC 3'

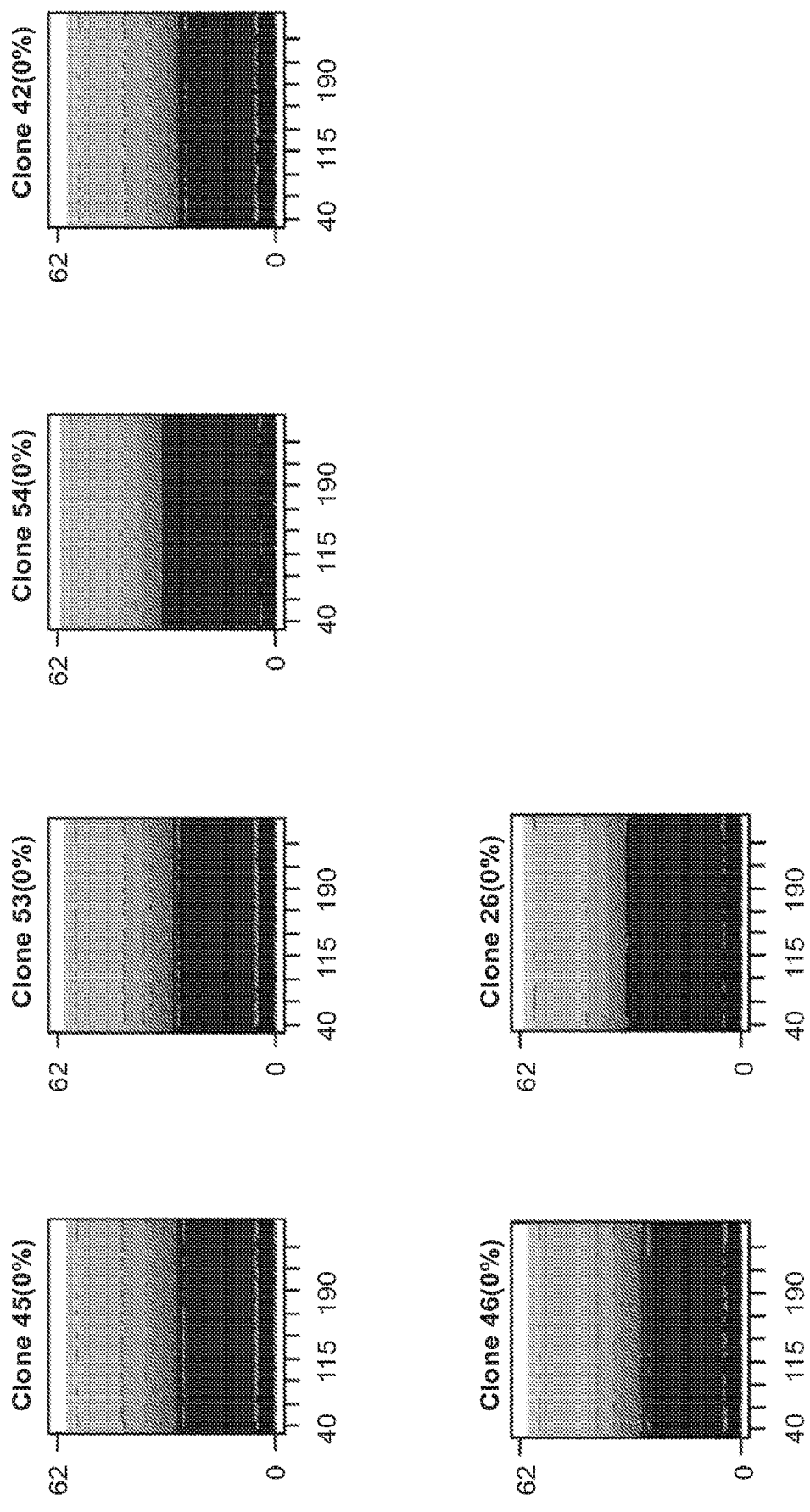

FIG. 16

|  | PK15-1974 | CLONE 15 | CLONE 20 | CLONE 29 | CLONE 38 | CLONE 40 | CLONE 41 |
|---|---|---|---|---|---|---|---|
| Chromosome 1 | | | | | | | |
| Chromosome 2 | | add(2)(p14.2) | | add(2)(p14.2) | add(2)(p14.2) | | add(2)(p14.2) |
| Chromosome 3 | add(3)p15 | add(3)(p15) | add(3)(p15) | add(3)(p15) | add(3)(p15) | add(3)p15 | add(3)(p15) |
| Chromosome 4 | | (+4) | (+4,+4) | add(4)(p13.1) | add(4)(p15.1), add(4)(p13.1) | (+4,+4,+4) | (+4) |
| Chromosome 5 | -5 | -5 | -5 | -5 | -5 | (-5,-5) | -5 |
| Chromosome 6 | -6 | | | | | | |
| Chromosome 7 | -7 | -7 | der(7;16)(q10;q10) | -7 | -7 | der(7;16)(q10;q10) | -7 |
| Chromosome 8 | | | | | | | |
| Chromosome 9 | -9 | | | | | | |
| Chromosome 10 | -10 | -10 | -10 | -10 | -10 | -10 | -10 |
| Chromosome 11 | -11 | | | | | | |
| Chromosome 12 | | | | | | | |
| Chromosome 13 | | | | | | | |
| Chromosome 14 | t | der(14;15)(q10;q10), add(14)(p10) | der(14;15)(q10;q10), add(14)(p10) | der(14;15)(q10;q10), add(14)(p10) | der(14;15)(q10;q10), add(14)(p10) | der(14;15)(q10;q10), add(14)(p10) | der(14;15)(q10;q10), add(14)(p10) |
| Chromosome 15 | | | | | | | |
| Chromosome 16 | | -16 | | -16 | -16 | -16 | -16 |
| Chromosome 17 | (-17)i(17)(q10) | (-17)i(17)(q10) | (-17)i(17)(q10) | (-17)i(17)(q10) | (-17)i(17)(q10) | (-17)i(17)(q10) | (-17)i(17)(q10) |
| Chromosome 18 | | | | | | | |
| X,Y | XX | XX | XX | XX | XX | XX | XX |
| A | n/a | +4mar [8] | +1~5mar [cp10] | +4mar [9] | +3~4mar [cp10] | +1~5mar [cp10] | +4mar [5] |

FIG. 17

| Nomenclature | Meaning |
|---|---|
| + | gain of a chromosome |
| - | loss of a chromosome |
| (:) | break (in detailed descriptions) |
| () | Surround structurally altered chromosomes and breakpoints |
| add | additional material of unknown origin |
| der | derivative chromosome |
| i | isochromosome |
| p | short arm of a chromosome |
| q | long arm of a chromosome |
| t | translocation |
| a | abnormality |

FIG. 18
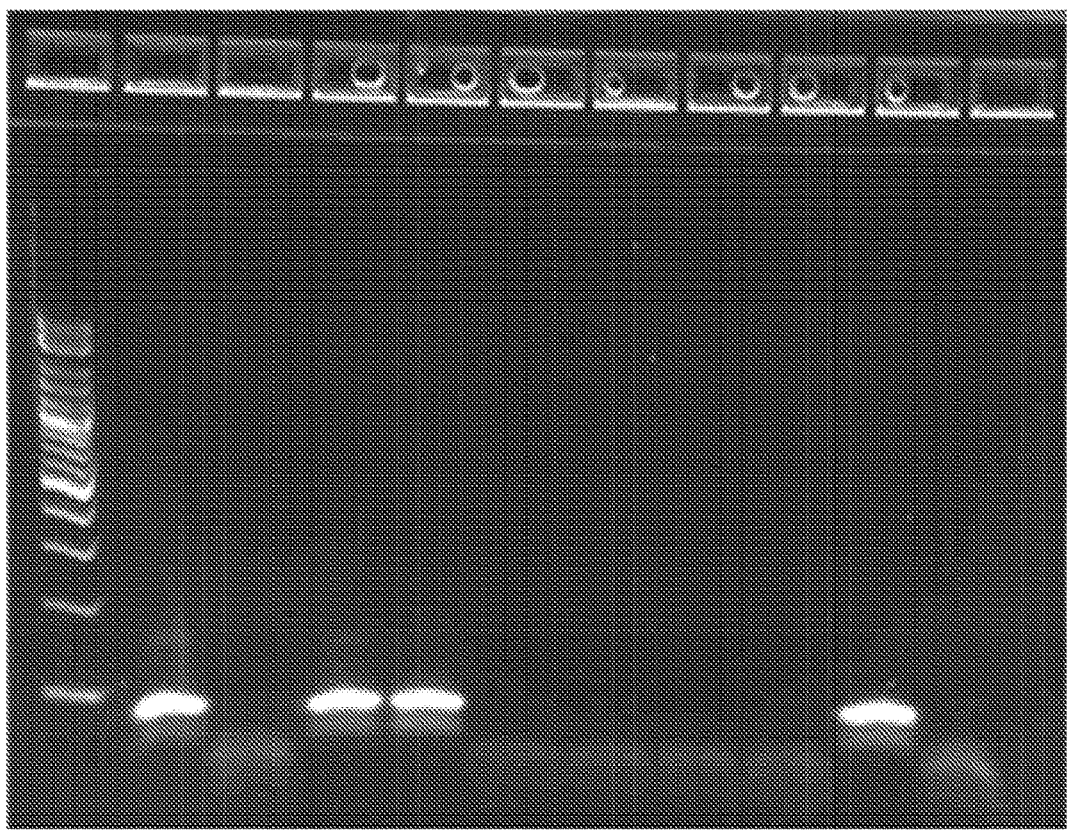
FIG. 19
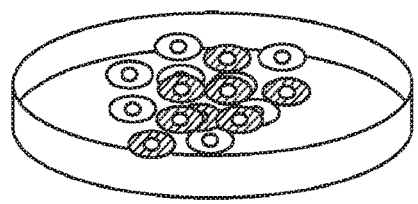
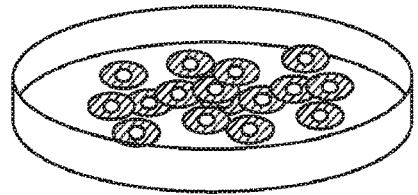

FIG. 23A
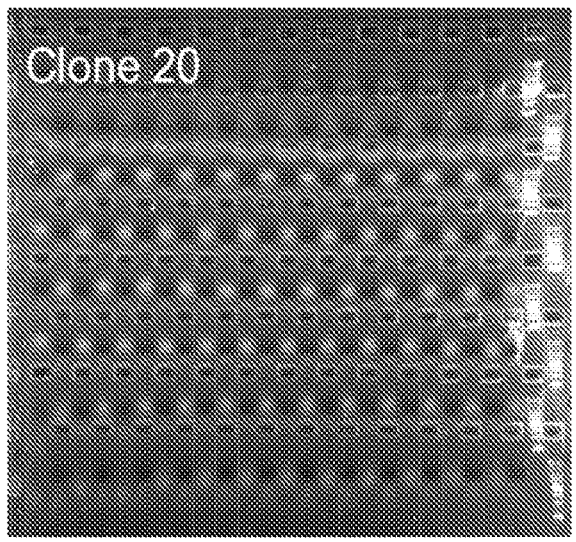
FIG. 23B
FIG. 23C
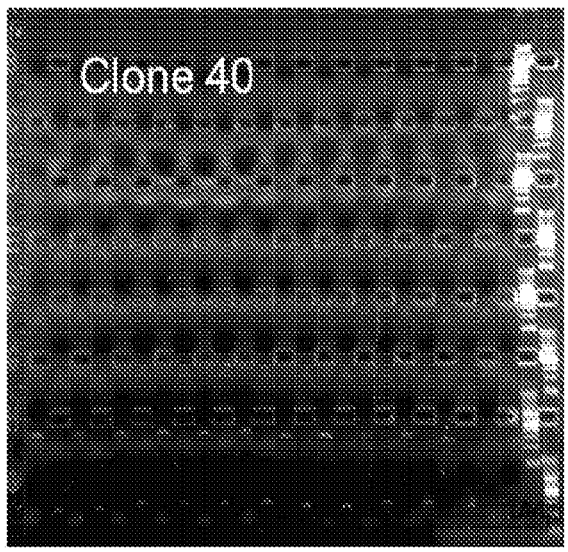
FIG. 23D
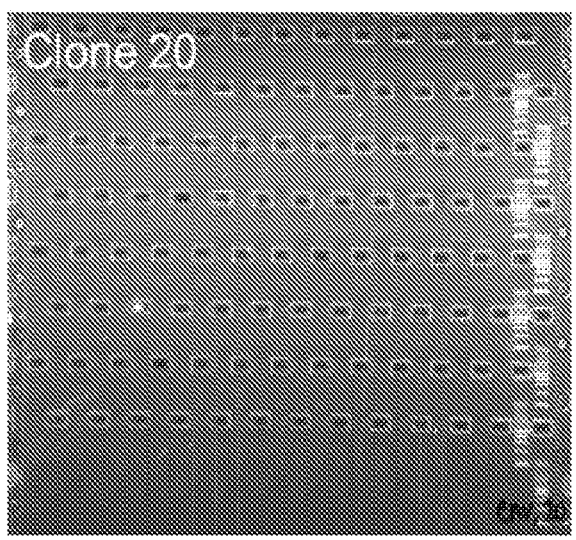
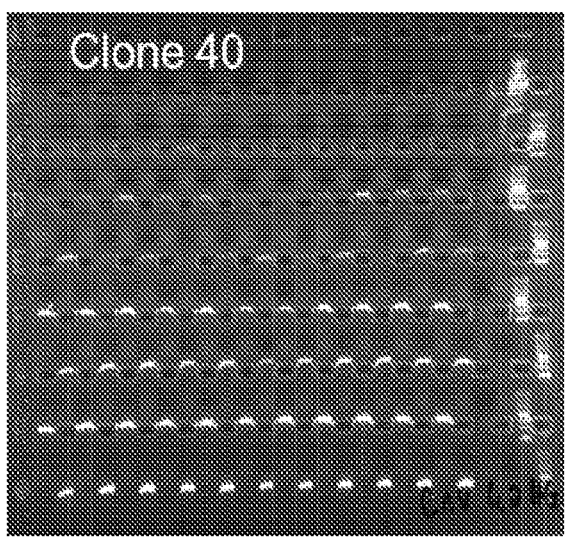

| | Clone 15 | Clone 20 | Clone 29 | Clone 38 | Clone 40 | Clone 41 | PK15 |
|---|---|---|---|---|---|---|---|
| Cas9 | 782 | 771 | 207 | 416 | 61 | 78 | 0 |
| gRNA1 | 5 | 3 | 2 | 1 | 0 | 0 | 0 |
| gRNA2 | 4 | 4 | 2 | 1 | 0 | 0 | 0 |
| Total | 75815790 | 72609563 | 82295929 | 72569325 | 60990510 | 80508090 | 0 |

FIG. 27B

| Sample | Name |
|---|---|
| | KRT18 |
| | IL1A |
| | CCND2 |
| | CD14 |
| | NEFH |
| | CD44 |
| | CD38 |
| | EREG |
| | ENO2 |
| | BTG2 |
| | SAT1 |
| | SATB1 |
| | FAS |
| | GPX3 |
| | PLCB2 |
| | ERBB2 |
| | PMAIP1 |
| | IER3 |
| | TNFSF10 |
| | IGFBP6 |
| | XIAP |
| | CASP3 |
| | IFNGR1 |
| | ATF3 |
| | BCL2L2 |
| | BNIP3I |
| | TIMP1 |
| | CIM |
| | RETSAT |
| | PSEN1 |
| | DNAJC3 |
| | PFA15 |
| | IL18 |
| | APP |
| | LEE1 |
| | RHDB |
| | CLU |
| | PNASEL |
| | MCL1 |
| | PDCD4 |
| | BMP2 |
| | TNFRSF12A |
| | SDD2 |
| | CINNB1 |
| | BAX |
| | ERBB3 |
| | ANXA1 |
| | LGALS3 |
| | SDSIM1 |
| | ETF1 |
| | EBP |
| | LMNA |
| | GPX4 |
| | TIMP3 |
| | BCAP31 |

| | |
|---|---|
| | PLAT |
| | CYLD |
| | CAV1 |
| | CASP9 |
| | F2R |
| | NFDD9 |
| | AIFM3 |
| | CCND1 |
| | SPTAN1 |
| | BARA |
| | WEE1 |
| | CBFRRP |
| | PDGFRB |
| | GSR |
| | TSPO |
| | ADD1 |
| | IMGB2 |
| | ANKH |
| | RDCK1 |
| | PPP2RSB |
| | TGFBR3 |
| | ISG20 |
| | BTG3 |
| | GADD45B |
| | RFLA |
| | DPYD |
| | CDC25B |
| | IRF1 |
| | MADD |
| | DFFA |
| | SDD1 |
| | CASP2 |
| | BID |
| | TDP2A |
| | RHDT2 |
| | IGF2R |
| | BCL10 |
| | PSEN2 |
| | TXNIP |
| | CD2 |
| | PAK1 |
| | DNAJA1 |
| | BRCA1 |
| | CDK2 |
| | HSPB1 |
| | TGFB2 |
| | FDXR |
| | TAP1 |
| | PTK2 |
| | CASP6 |
| | MGMT |
| | SMAD7 |
| | MMP2 |
| | F2 |

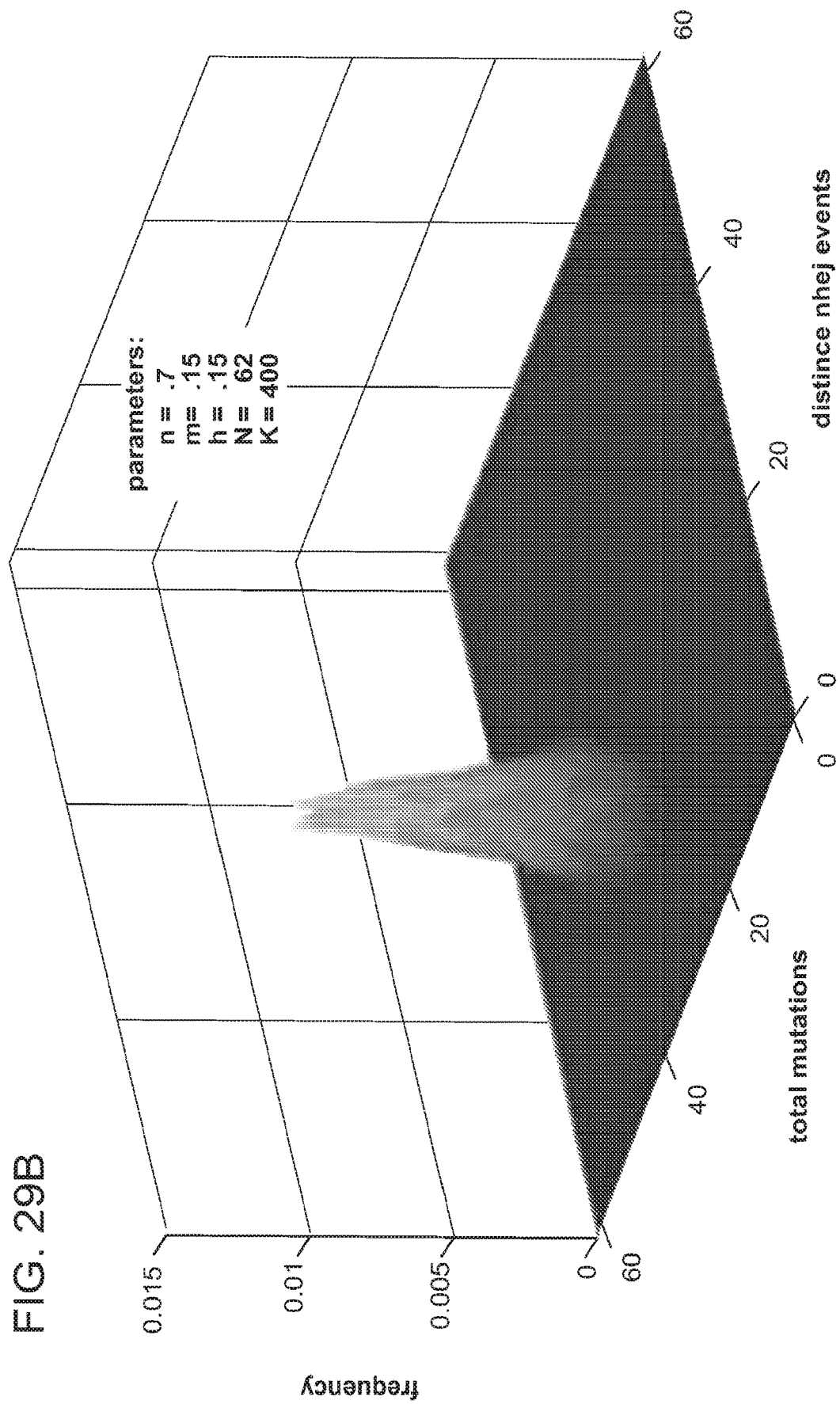

US 10,959,413 B2

MULTIPLEXED GENOME EDITING

RELATED APPLICATIONS

This application is a National Stage Application under 35 U.S.C. 371 of co-pending PCT application PCT/US2016/055916 designating the United States and filed Oct. 7, 2016; which claims the benefit of U.S. provisional application No. 62/239,239 and filed Oct. 8, 2015 each of which are hereby incorporated by reference in their entireties.

STATEMENT OF GOVERNMENT INTERESTS

This invention was made with government support under HG005550 awarded by the National Institutes of Health. The government has certain rights in the invention.

BACKGROUND OF THE INVENTION

Genome editing via sequence-specific nucleases is known. A nuclease-mediated double-stranded DNA (dsDNA) break in the genome can be repaired by two main mechanisms: Non-Homologous End Joining (NHEJ), which frequently results in the introduction of non-specific insertions and deletions (indels), or homology directed repair (HDR), which incorporates a homologous strand as a repair template. See reference 4 hereby incorporated by reference in its entirety. When a sequence-specific nuclease is delivered along with a homologous donor DNA construct containing the desired mutations, gene targeting efficiencies are increased by 1000-fold compared to just the donor construct alone.

Alternative methods have been developed to accelerate the process of genome modification by directly injecting DNA or mRNA of site-specific nucleases into the one cell embryo to generate DNA double strand break (DSB) at a specified locus in various species. DSBs induced by these site-specific nucleases can then be repaired by either error-prone non-homologous end joining (NHEJ) resulting in mutant mice and rats carrying deletions or insertions at the cut site. If a donor plasmid with homology to the ends flanking the DSB is co-injected, high-fidelity homologous recombination can produce animals with targeted integrations. Because these methods require the complex designs of zinc finger nucleases (ZNFs) or Transcription activator-like effector nucleases (TALENs) for each target gene and because the efficiency of targeting may vary substantially, no multiplexed gene targeting has been reported to date.

Thus, improved methods for producing genetically modified cells to generate animals, such as pigs, are needed for potential sources of organs for transplantation.

SUMMARY OF THE INVENTION

Described herein is the use of the Clustered Regularly Interspaced Short Palindromic Repeats (CRISPR) and CRISPR associated (Cas) proteins (CRISPR/Cas) system to achieve highly efficient and simultaneous targeting of multiple nucleic acid sequences in cells.

Aspects of the present disclosure are directed to the modification of genomic DNA, such as multiplex modification of DNA, in a cell (e.g., stem cell, somatic cell, germ line cell, zygote) using one or more guide RNAs (ribonucleic acids) to direct an enzyme having nuclease activity expressed by the cell, such as a DNA binding protein having nuclease activity, to a target location on the DNA (deoxyribonucleic acid) wherein the enzyme cuts the DNA and an exogenous donor nucleic acid is inserted into the DNA, such as by homologous recombination. Aspects of the present disclosure include cycling or repeating steps of DNA modification in a cell to create a cell having multiple modifications of DNA within the cell. Modifications can include insertion of exogenous donor nucleic acids. Modifications can include deletion of endogenous nucleic acids.

Multiple nucleic acid sequences can be modulated (e.g., inactivated) by a single step of introducing into a cell, which expresses an enzyme, and nucleic acids encoding a plurality of RNAs, such as by co-transformation, wherein the RNAs are expressed and wherein each RNA in the plurality guides the enzyme to a particular site of the DNA, the enzyme cuts the DNA. According to this aspect, many alterations or modification of the DNA in the cell are created in a single cycle.

According to one aspect, the cell expressing the enzyme has been genetically altered to express the enzyme such as by introducing into the cell a nucleic acid encoding the enzyme and which can be expressed by the cell. In this manner, aspects of the present disclosure include cycling the steps of introducing RNA into a cell which expresses the enzyme, introducing exogenous donor nucleic acid into the cell, expressing the RNA, forming a co-localization complex of the RNA, the enzyme and the DNA, and enzymatic cutting of the DNA by the enzyme. Insertion of a donor nucleic acid into the DNA is also provided herein. Cycling or repeating of the above steps results in multiplexed genetic modification of a cell at multiple loci, i.e., a cell having multiple genetic modifications.

According to certain aspects, DNA binding proteins or enzymes within the scope of the present disclosure include a protein that forms a complex with the guide RNA and with the guide RNA guiding the complex to a double stranded DNA sequence wherein the complex binds to the DNA sequence. According to one aspect, the enzyme can be an RNA guided DNA binding protein, such as an RNA guided DNA binding protein of a Type II CRISPR System that binds to the DNA and is guided by RNA. According to one aspect, the RNA guided DNA binding protein is a Cas9 protein.

This aspect of the present disclosure may be referred to as co-localization of the RNA and DNA binding protein to or with the double stranded DNA. In this manner, a DNA binding protein-guide RNA complex may be used to cut multiple sites of the double stranded DNA so as to create a cell with multiple genetic modifications, such as disruption of one or more (e.g., all) copies of a gene.

According to certain aspects, a method of making multiple alterations to target DNA in a cell expressing an enzyme that forms a co-localization complex with RNA complementary to the target DNA and that cleaves the target DNA in a site specific manner is provided including (a) introducing into the cell a first foreign nucleic acid encoding one or more RNAs complementary to the target DNA and which guide the enzyme to the target DNA, wherein the one or more RNAs and the enzyme are members of a co-localization complex for the target DNA, wherein the one or more RNAs and the enzyme co-localize to the target DNA, the enzyme cleaves the target DNA to produce altered DNA in the cell, and repeating step (a) multiple times to produce multiple alterations to the DNA in the cell.

In some aspects, a method of inactivating expression of one or more target nucleic acid sequences in a cell comprises introducing into a cell one or more ribonucleic acid (RNA) sequences that comprise a portion that is complementary to all or a portion of each of the one or more target nucleic acid sequences, and a nucleic acid sequence that encodes a Cas protein; and maintaining the cells under conditions in which the Cas protein is expressed and the Cas protein binds and inactivates the one or more target nucleic acid sequences in the cell.

In other aspects, a method of modulating one or more target nucleic acid sequences in a cell comprises introducing into the cell a nucleic acid sequence encoding an RNA complementary to all or a portion of a target nucleic acid sequence in the cell; introducing into the cell a nucleic acid sequence encoding an enzyme that interacts with the RNA and cleaves the target nucleic acid sequence in a site specific manner; and maintaining the cell under conditions in which the RNA binds to complementary target nucleic acid sequence forming a complex, and wherein the enzyme binds to a binding site on the complex and modulates the one or more target nucleic acid sequences.

In the methods described herein, the introducing step can comprise transfecting the cell with the one or more RNA sequences and the nucleic acid sequence that encodes the Cas protein.

In some embodiments, the one or more RNA sequences, the nucleic acid sequence that encodes the Cas protein, or a combination thereof are introduced into a genome of the cell.

In some embodiments, the expression of the Cas protein is induced.

In the methods described, herein the cell is from an embryo. The cell can be a stem cell, zygote, or a germ line cell. In embodiments where the cell is a stem cell, the stem cell is an embryonic stem cell or pluripotent stem cell. In other embodiments, the cell is a somatic cell. In embodiments, where the cell is a somatic cell, the somatic cell is a eukaryotic cell or prokaryotic cell. The eukaryotic cell can be an animal cell, such as from a pig, mouse, rat, rabbit, dog, horse, cow, non-human primate, human.

The one or more target nucleic acid sequences can comprise a porcine endogenous retrovirus (PERV) gene. For example, the PERV gene can comprise a pol gene.

The methods described herein can inactivate, modulate, or effect one or more copies of the pol gene. In some embodiments, all copies of the pol gene in the cell are inactivated.

In some embodiments, the Cas protein is a Cas9.

In some embodiments, the one or more RNA sequences can be about 10 to about 1000 nucleotides. For example, the one or more RNA sequences can be about 15 to about 200 nucleotides.

In some aspects an engineered cell comprises one or more endogenous viral genes; and one or more exogenous nucleic acid sequences that comprise a portion that is complementary to all or a portion of one or more target nucleic acid sequences of the one or more endogenous viral genes; wherein each of the one or more endogenous viral genes of the cell are modulated.

In another aspect, an engineered cell can comprise a plurality of endogenous retroviral genes; and one or more exogenous nucleic acid sequences that comprise a portion that is complementary to all or a portion of one or more target nucleic acid sequences of the plurality of endogenous viral genes; wherein each of the plurality of endogenous viral genes of the cell are modulated.

The engineered cells described herein can comprise a porcine endogenous retrovirus (PERV) gene. For example, the PERV gene can comprise a pol gene.

In some aspects, modulation of the pol gene inactivates one or more copies of the pol gene. For example, all or substantially all copies of the pol gene in the cell are inactivated.

According to one aspect, the RNA is between about 10 to about 1000 nucleotides. According to one aspect, the RNA is between about 20 to about 100 nucleotides.

According to one aspect, the one or more RNAs is a guide RNA. According to one aspect, the one or more RNAs is a tracrRNA-crRNA fusion.

According to one aspect, the DNA is genomic DNA, mitochondrial DNA, viral DNA, or exogenous DNA.

BRIEF DESCRIPTION OF THE DRAWINGS

FIGS. 2A-2B illustrate clonal PK15 cells with inactivation of all copies of PREV pol genes after Cas9 treatment. (A) A bimodal distribution of pol targeting efficiencies was observed among the single-cell-derived PK15 clones after 17 days of Cas9 induction. 45/50 exhibited <16% targeting efficiency; 5/50 clones exhibited >93% targeting efficiency. (B) PK15 haplotypes at PERV pol loci after CRISPR-Cas9 treatment. In red, indel events in the PERV pol sequence are represented. Shades of purple indicate endogenous PERVs.

FIG. 10 (S7) illustrates Sanger sequencing validation of PERV targeting efficiency and indel patterning. (SEQ ID NO:29 represents the complete sequence of the 8 sequence fragments as shown.)

FIG. 16 (S13) illustrates Summary of karyotype analysis of PK15 clones.

FIG. 17 (S14) illustrates Karyotype nomenclature.

FIG. 18 (S15) illustrates Detection of PERV reverse transcriptase activity.

FIG. 19 (S16) illustrates an experimental design to detect the transmission of PERVs to human cells.

FIGS. 23A-23D (S20) illustrates detection of PERV DNA elements in HEK293 cells using PERV env primers.

FIGS. 27A-27B (S24) illustrate gene set enrichment analysis.

FIGS. 29A-29D (S26) illustrates a Markov model analysis of DNA repair processes leading to Cas9 elimination of active PERV elements.

DETAILED DESCRIPTION OF THE INVENTION

Aspects of the present invention are directed to the use of CRISPR/Cas9, for nucleic acid engineering. Described herein is the development of an efficient technology for the generation of animals (e.g., pigs) carrying multiple mutated genes. Specifically, the clustered regularly interspaced short palindromic repeats (CRISPR) and CRISPR associated genes (Cas genes), referred to herein as the CRISPR/Cas system, has been adapted as an efficient gene targeting technology e.g., for multiplexed genome editing. Demonstrated herein is that CRISPR/Cas mediated gene editing allows the simultaneous inactivation of 62 copies of the porcine endogenous retrovirus (PERV) pol gene in a porcine kidney epithelial cell line (e.g., PK15) with high efficiency. Co-injection or transfection of Cas9 mRNA and guide RNA (gRNA) targeting PERVs into cells generated a greater than 1000 fold reduction in PERV transmission to human cells with biallelic mutations in both genes with an efficiency of up to 100%. Shown herein is that the CRISPR/Cas system allows the one step generation of cells carrying inactivation of all copies of PERV. In certain embodiments a method described herein generates cell and animals, e.g., pigs, with inactivation of 1, 2, 3, 4, 5, or more genes with an efficiency of between 20% and 100%, e.g., at least 20%, 30%, 40%, 50%, 60%, 70%, 80%, 85%, 90%, 95%, or more, e.g., up to 96%, 97%, 98%, 99%, or more.

EXEMPLIFICATION

Example 1. Genome-Wide Inactivation of Porcine Endogenous Retroviruses (PERVs)

The shortage of organs for transplantation is a major barrier to the treatment of organ failure. While porcine organs are considered promising, their use has been checked by concerns about transmission of porcine endogenous retroviruses (PERVs) to humans. Here, the eradication of all PERVs in a porcine kidney epithelial cell line (PK15) was performed. It was first determined the PK15 PERV copy number to be 62. Using CRISPR-Cas9, all 62 copies of the PERV pol gene were disrupted and demonstrated a >1000-fold reduction in PERV transmission to human cells using our engineered cells. This study showed that CRISPR-Cas9 multiplexability can be as high as 62 and demonstrates the possibility that PERVs can be inactivated for clinical application to porcine-to-human xenotransplantation.

Pig genomes contain from a few to several dozen copies of PERV elements. Unlike other zoonotic pathogens, PERVs cannot be eliminated by biosecure breeding. Prior strategies for reducing the risk of PERV transmission to humans have included small interfering RNAs (RNAi), vaccines, and PERV elimination using zinc finger nucleases and TAL effector nucleases, but these have had limited success. Here, the successful use of the CRISPR-Cas9 RNA-guided nuclease system can be used to inactivate all copies of the PERV pol gene and effect a 1000-fold reduction of PERV infectivity of human cells.

Figure 1A:
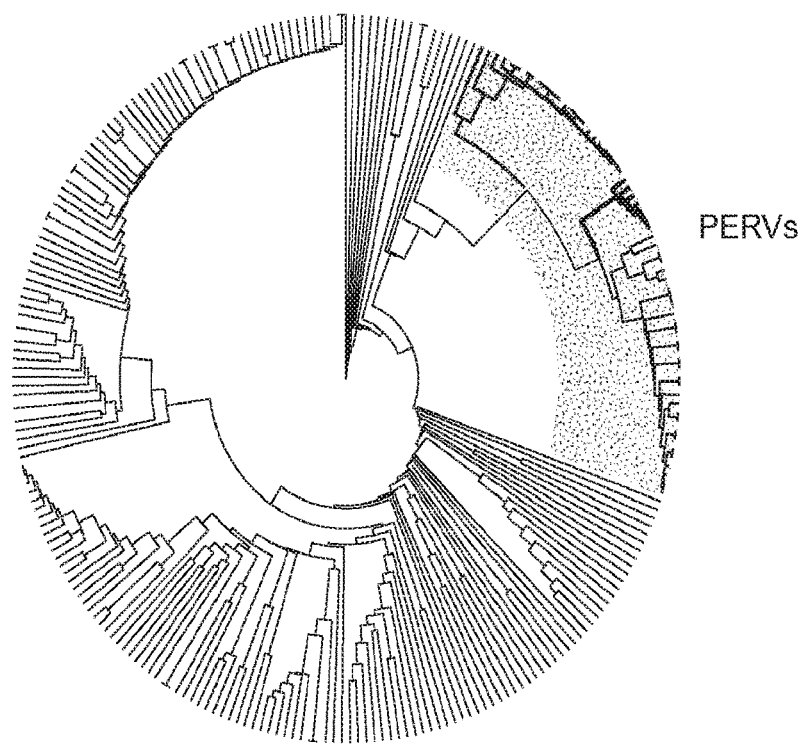
FIGS. 1A-1C illustrate CRISPR-Cas9 gRNAs were designed to specifically target the pol gene in 62 copies of PERVs in PK15 cells. (A) Phylogenetic tree representing endogenous retroviruses present in the pig genome. PERVs are highlighted in blue. (B) Copy number determination of PERVs in PK15 cells via digital droplet PCR. The copy number of pol elements was estimated to be 62 using three independent reference genes: ACTB, GAPDH, and EB2. N=3, mean+/−SEM. (C) Two CRISPR-Cas9 gRNAs were designed to target the catalytic region of the PERV pol gene. The two gRNA targeting sequences are shown below a schematic of PERV gene structure. Their PAM sequences are highlighted in red. (SEQ ID NO:27-28)
Figure 1B:
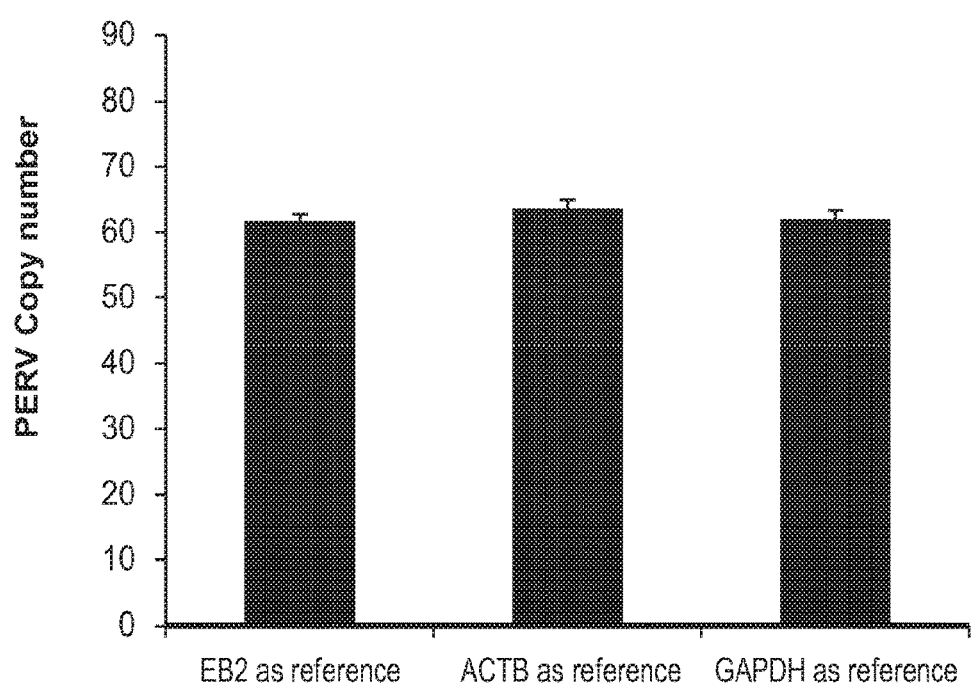
Figure 1C:
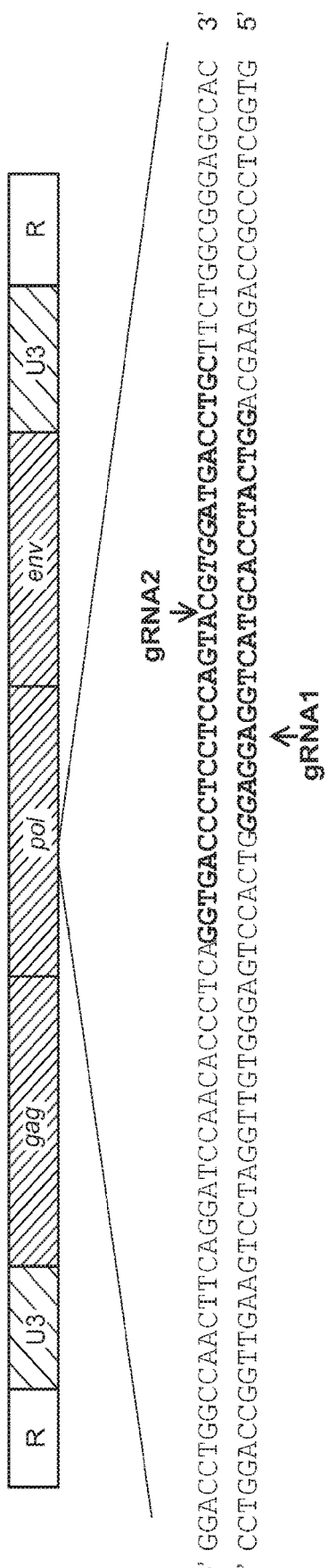
Figure 4:
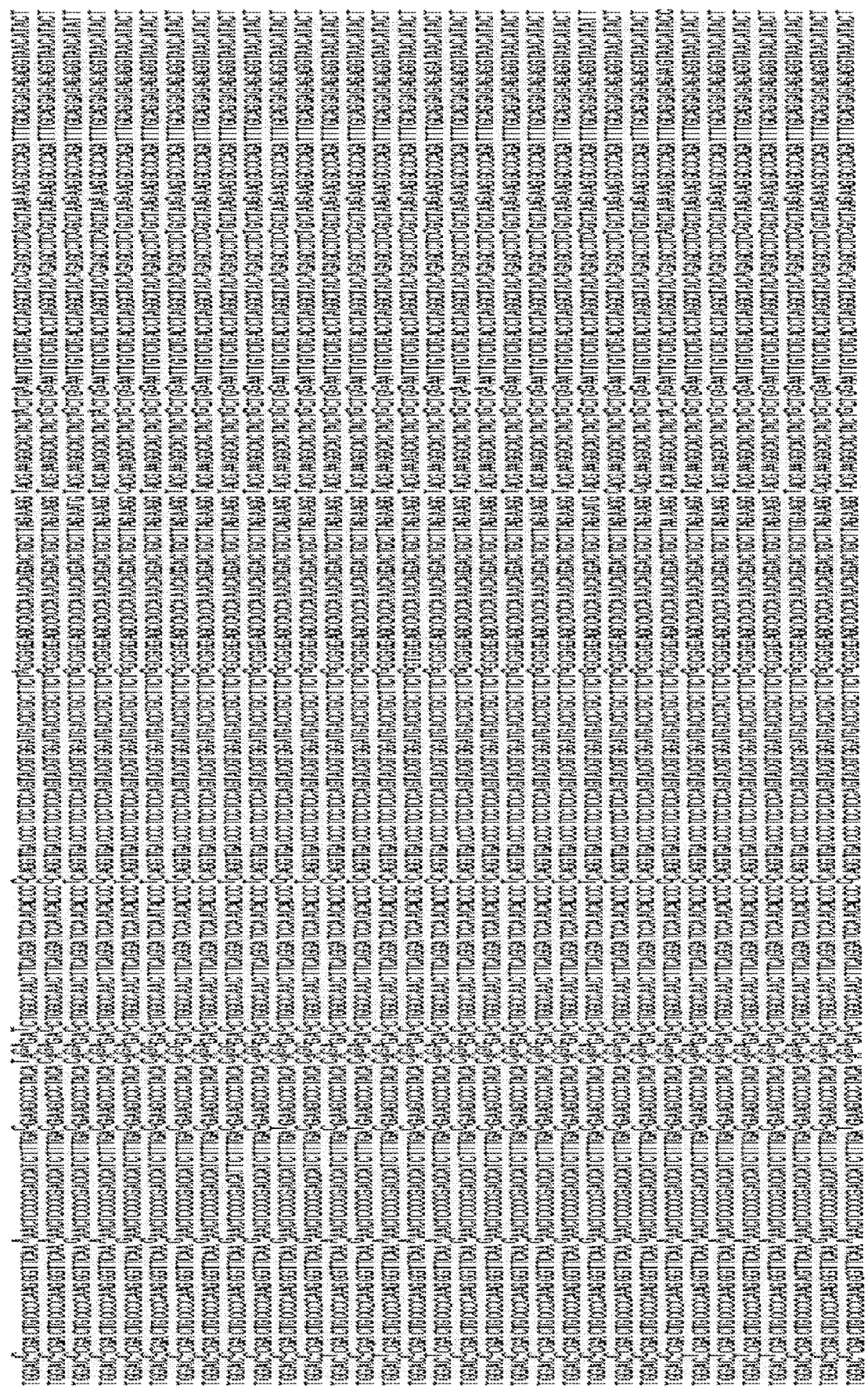
FIG. 4 (S1) illustrates PERV pol consensus sequence and gRNA design (SEQ ID NOS:281-342).

To design Cas9 guide RNAs (gRNAs) that specifically target PERVs, the sequences of publically available PERVs and other endogenous retroviruses in pigs (Methods) were analyzed. A distinct clade of PERV elements (FIG. 1A) were identified and determined there to be 62 copies of PERVs in PK15 cells using droplet digital PCR (FIG. 1B). Two Cas9 guide RNAs (gRNAs) were designed that targeted the highly conserved catalytic center of the pol gene on PERVs (FIG. 1C, FIG. 4). The pol gene product functions as a reverse transcriptase (RT) and is thus essential for viral replication and infection. It was determined that these gRNAs targeted all PERVs but no other endogenous retrovirus or other sequences in the pig genome (Methods).

Figure 5:
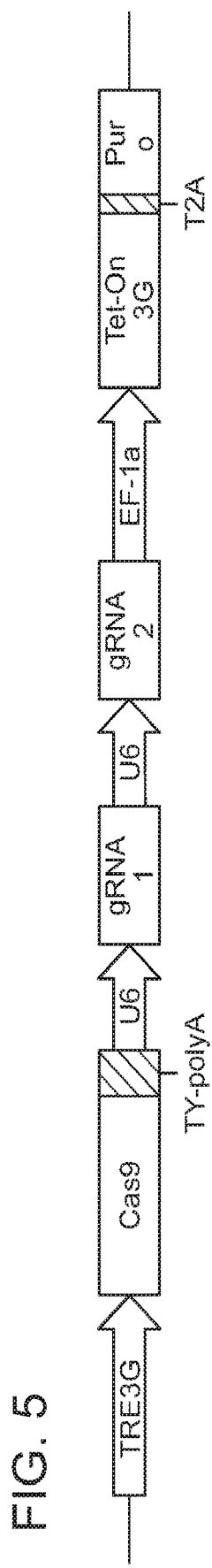
FIG. 5 (S2) is a schematic of CRISPR/Cas9 construct targeting PERVs.
Figure 6:
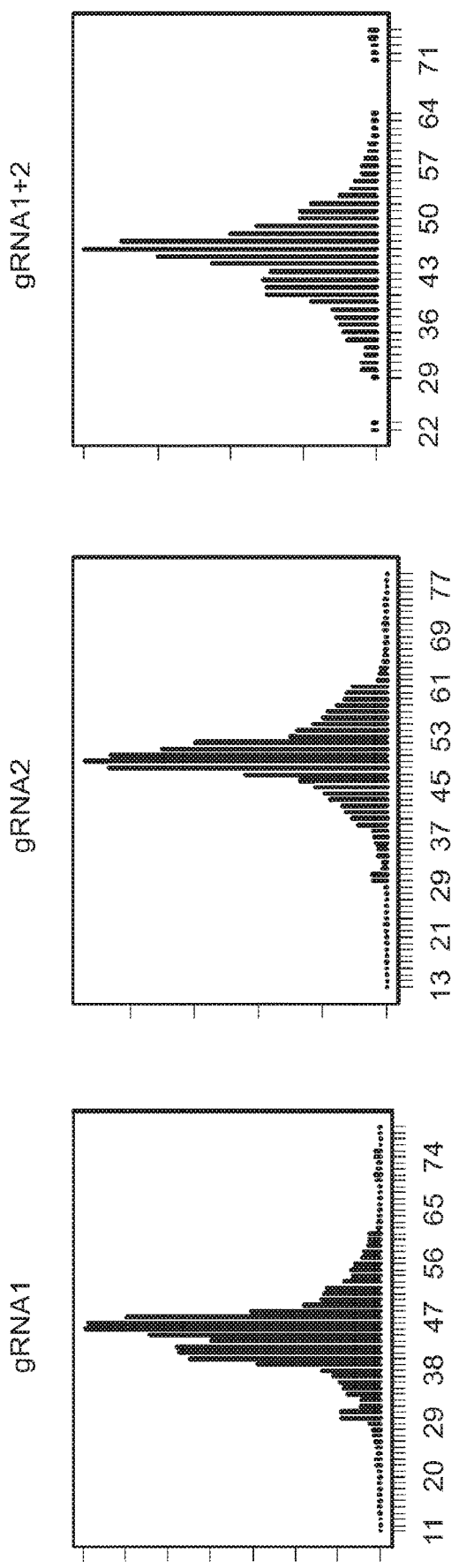
FIG. 6 (S3) illustrates measurement of Cas9-gRNAs activity.
Figure 7:
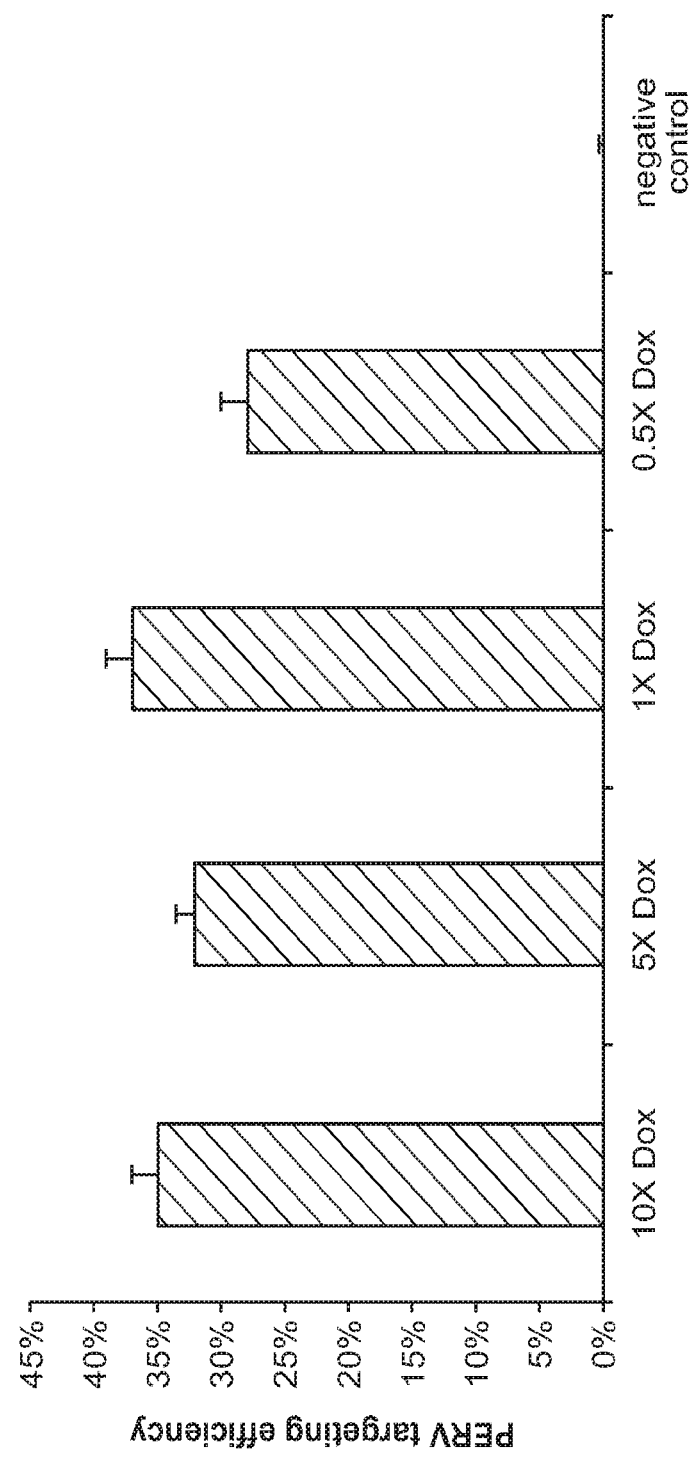
FIG. 7 (S4) illustrates optimization of DOX concentration to induce Cas9 expression for PERV targeting.
Figure 8:
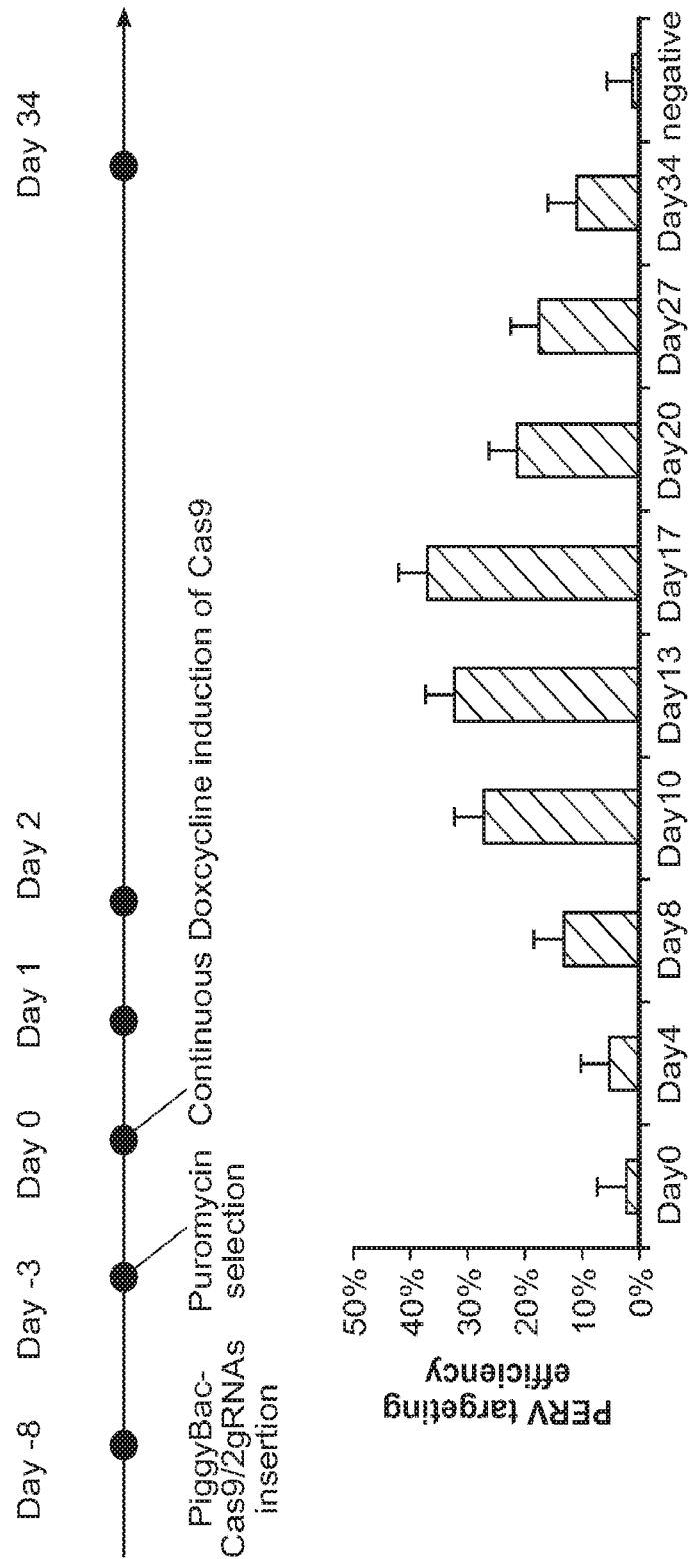
FIG. 8 (S5) illustrates time series measurement of Piggybac-Cas9/gRNAs PERV targeting efficiencies.
Figure 9:
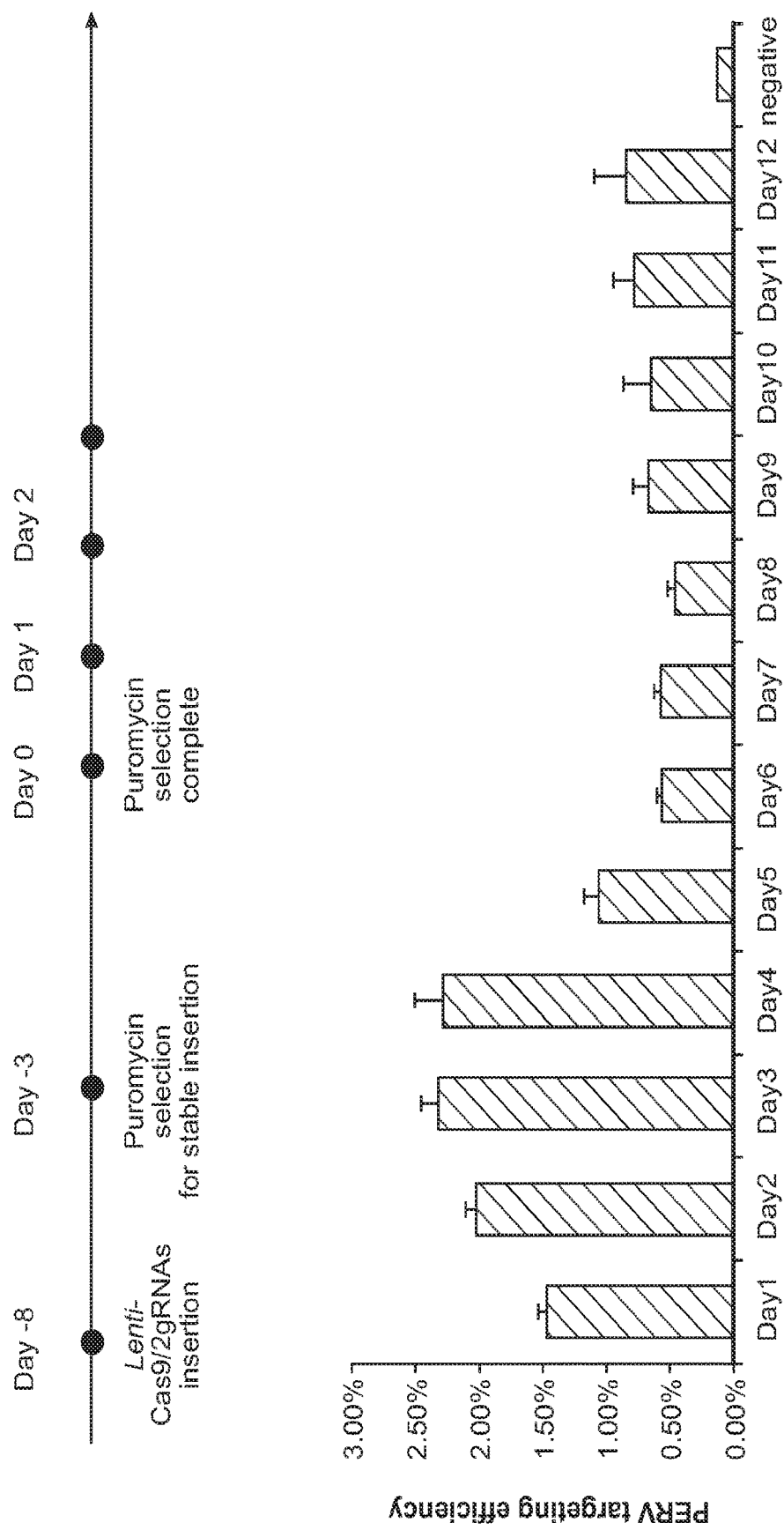
FIG. 9 (S6) illustrates time series measurement of Lenti-Cas9/2gRNAs PERV targeting efficiency.
Figure 11:
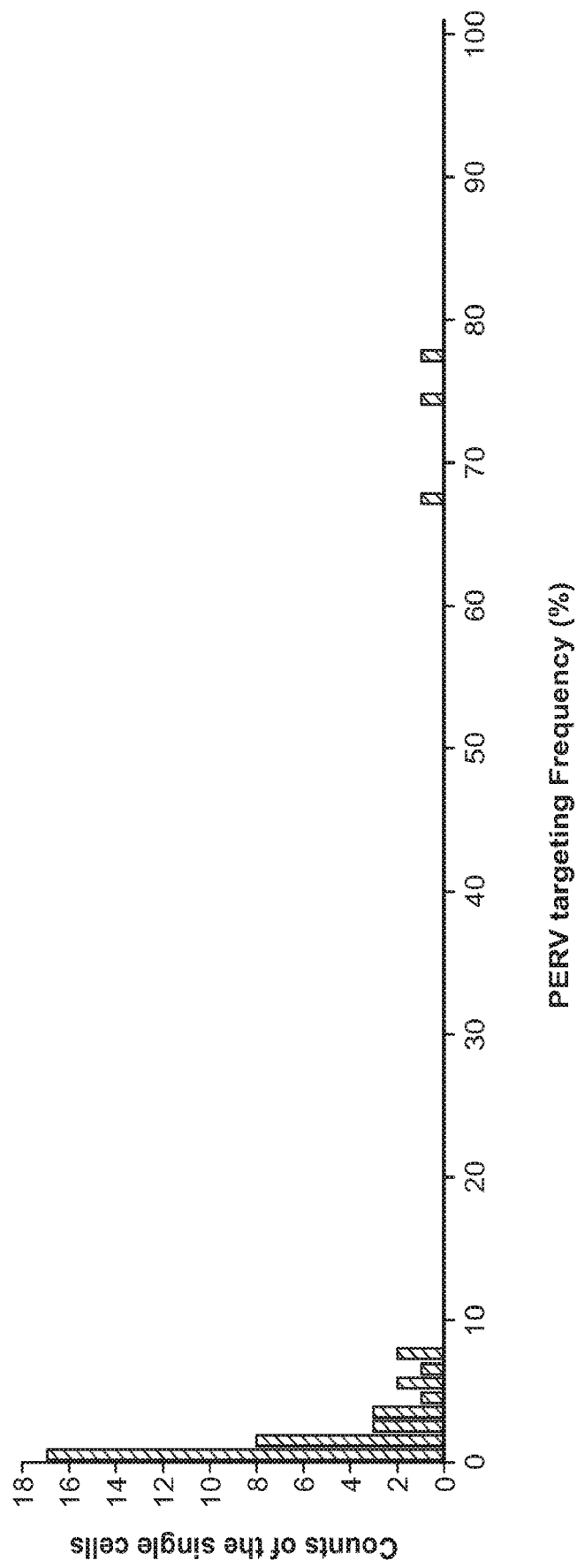
FIG. 11 (S8) illustrates repeated the gene editing experiment.
Figure 12A:
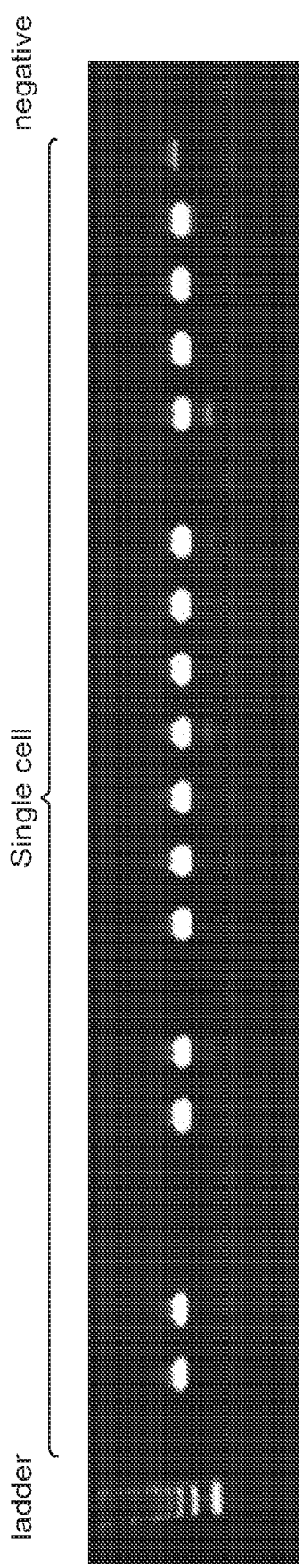
FIGS. 12A-B (S9) illustrates PERV pol targeting efficiency of single cells.
Figure 12B:
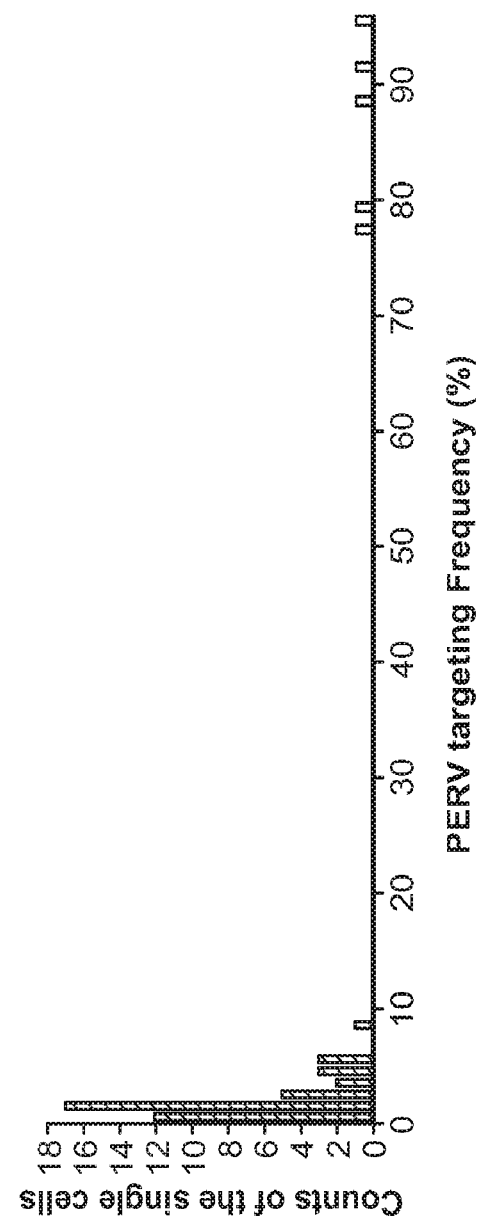

Initial experiments showed inefficient PERV editing when Cas9 and the gRNAs were transiently transfected (FIG. 5). Thus a PiggyBac transposon system was used to deliver a doxycycline-inducible Cas9 and the two gRNAs into the genome of PK15 cells (FIGS. 5-6). Continuous induction of Cas9 led to increased targeting frequency of the PERVs (FIG. 8), with a maximum targeting frequency of 37% (~23 PERV copies per genome) observed on day 17 (FIG. 8). Neither higher concentrations of doxycycline or prolonged incubation increased targeting efficiency (FIGS. 7-8), possibly due to the toxicity of non-specific DNA damage by CRISPR-Cas9. Similar trends were observed when Cas9 was delivered using lentiviral constructs (FIG. 9). The cell lines that exhibited maximal PERV targeting efficiencies were genotyped. 455 different insertion and deletion (indel) events centered at the two gRNA target sites (FIG. 2B) was observed. Indel sizes ranged from 1 to 148 bp; 80% of indels were small deletions (<9 bp). The initial deep sequencing results was validated with Sanger Sequencing (FIG. 10).

Figure 2B:
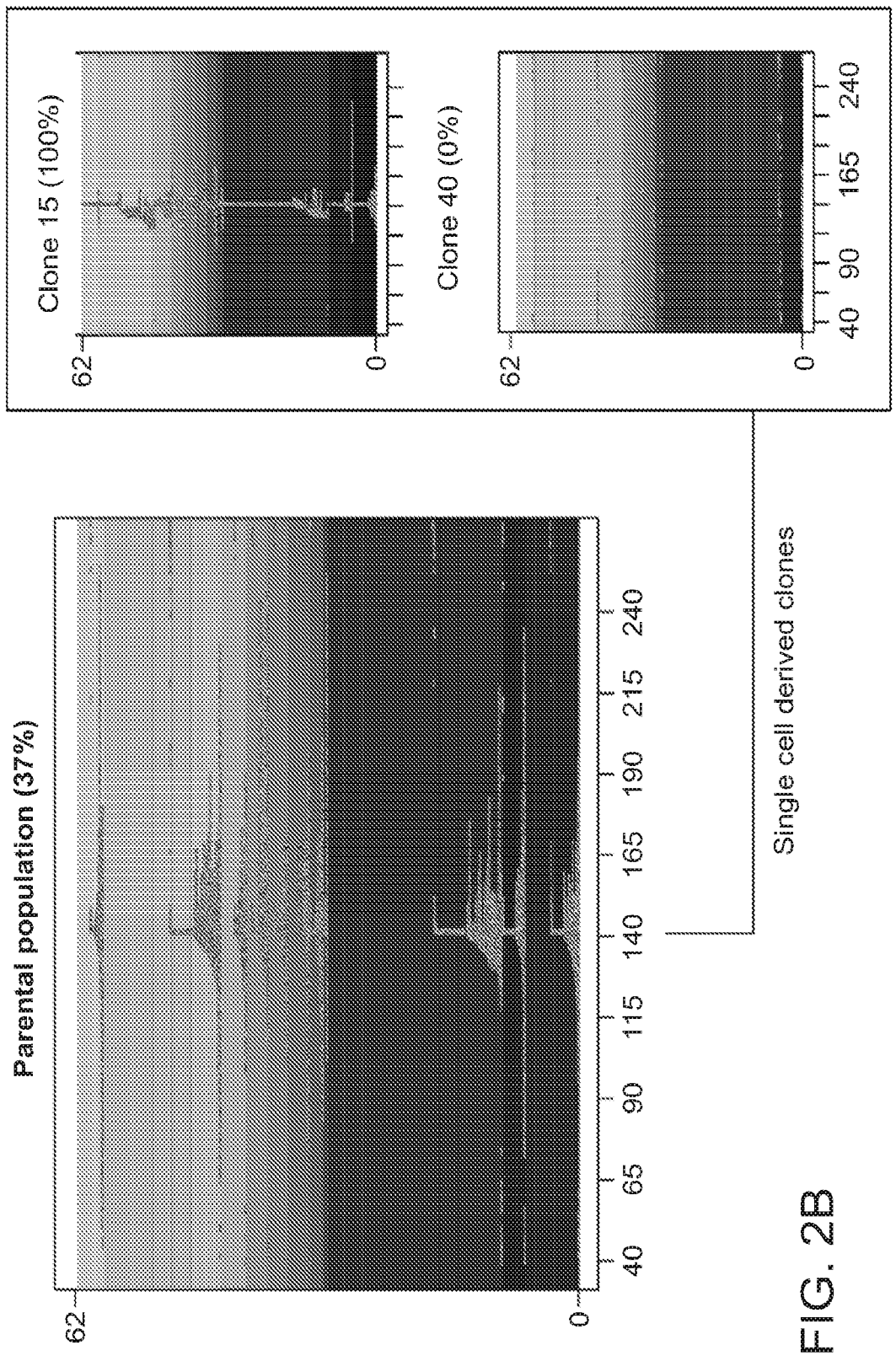
Figure 13:
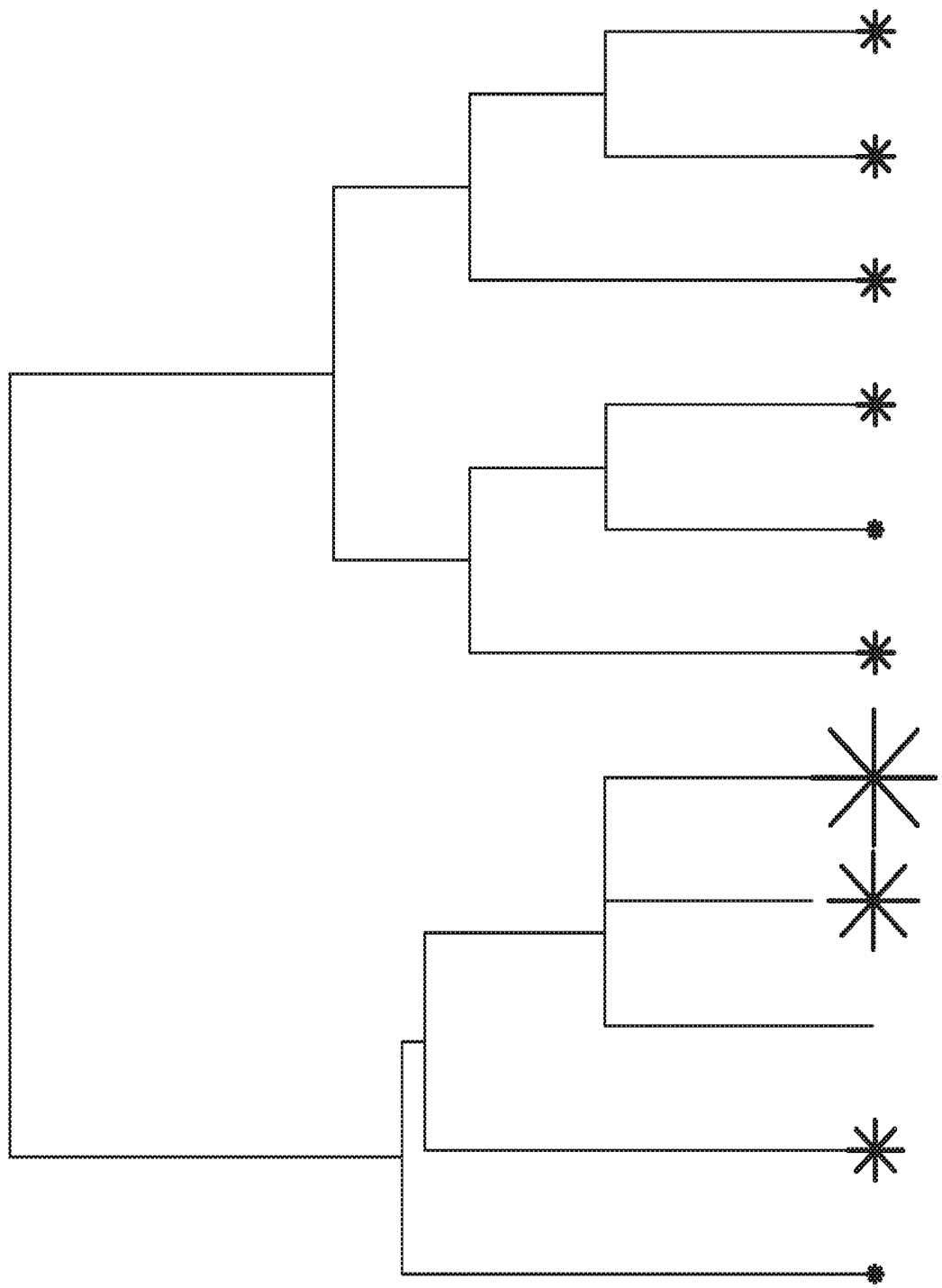
FIG. 13 (S10) illustrates phylogeny of PERV haplotypes.
Figure 14:
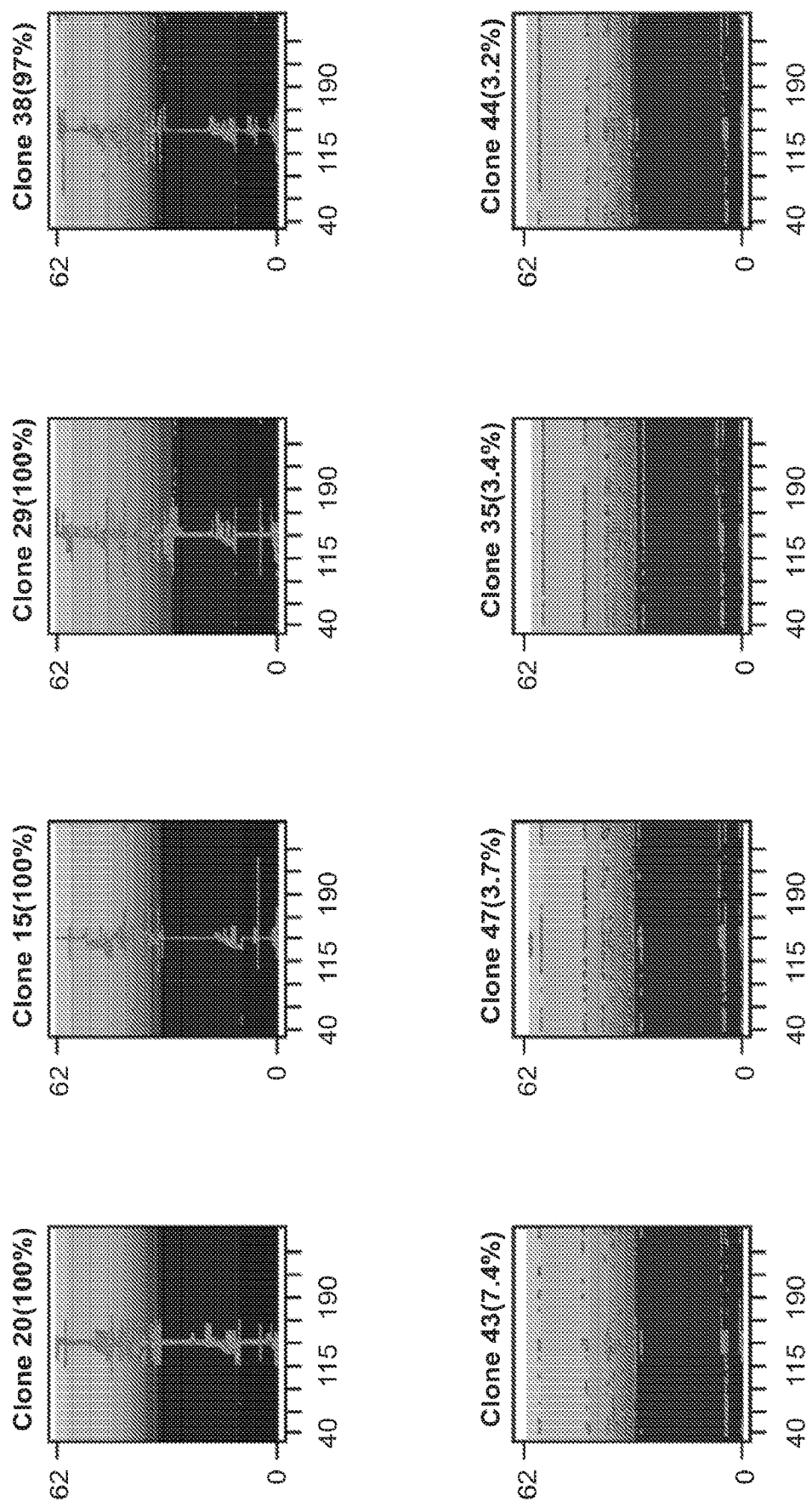
FIG. 14 (S11) illustrates distribution of pol gene disruption.
Figure 14:
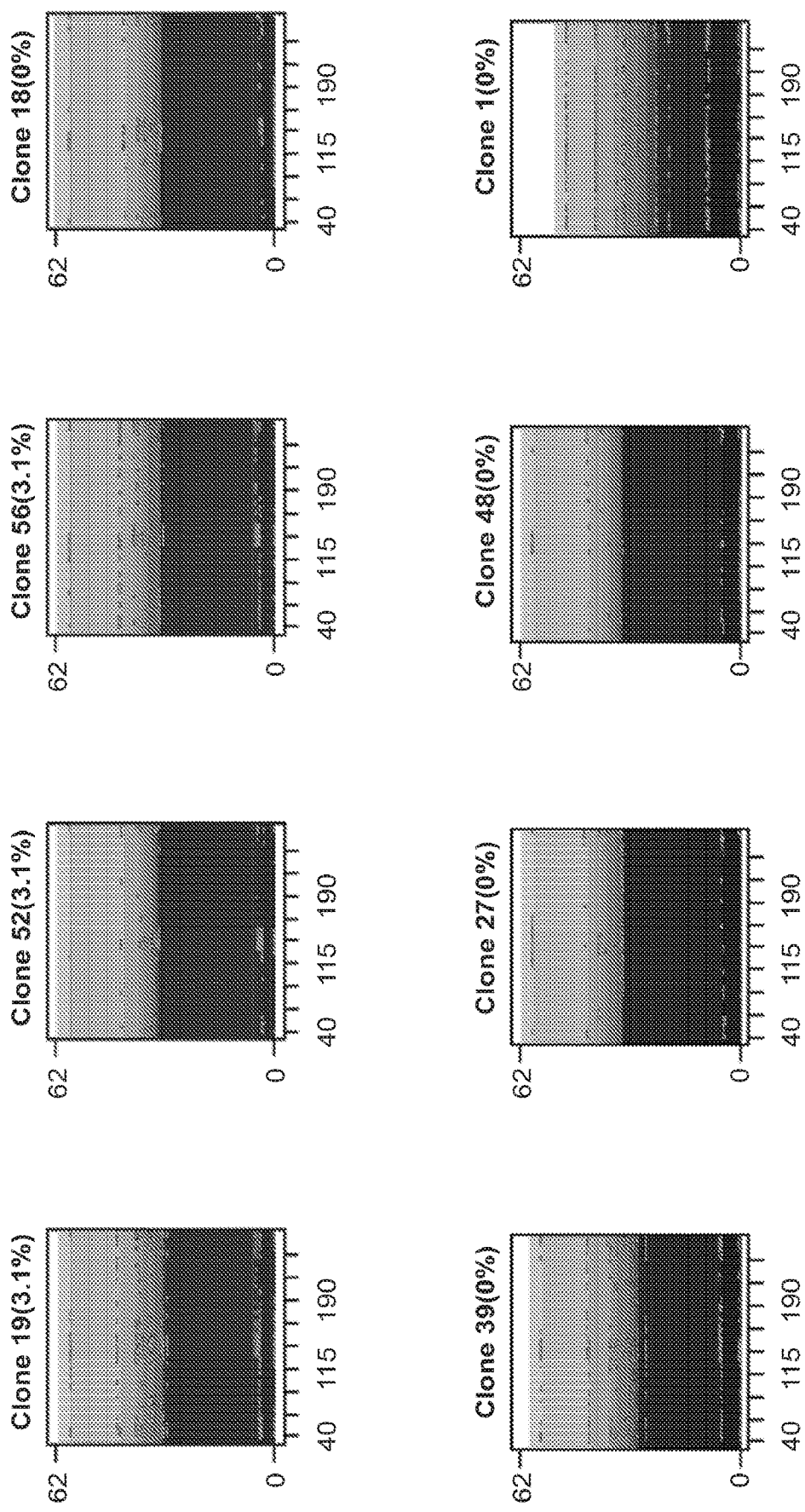
Figure 14:
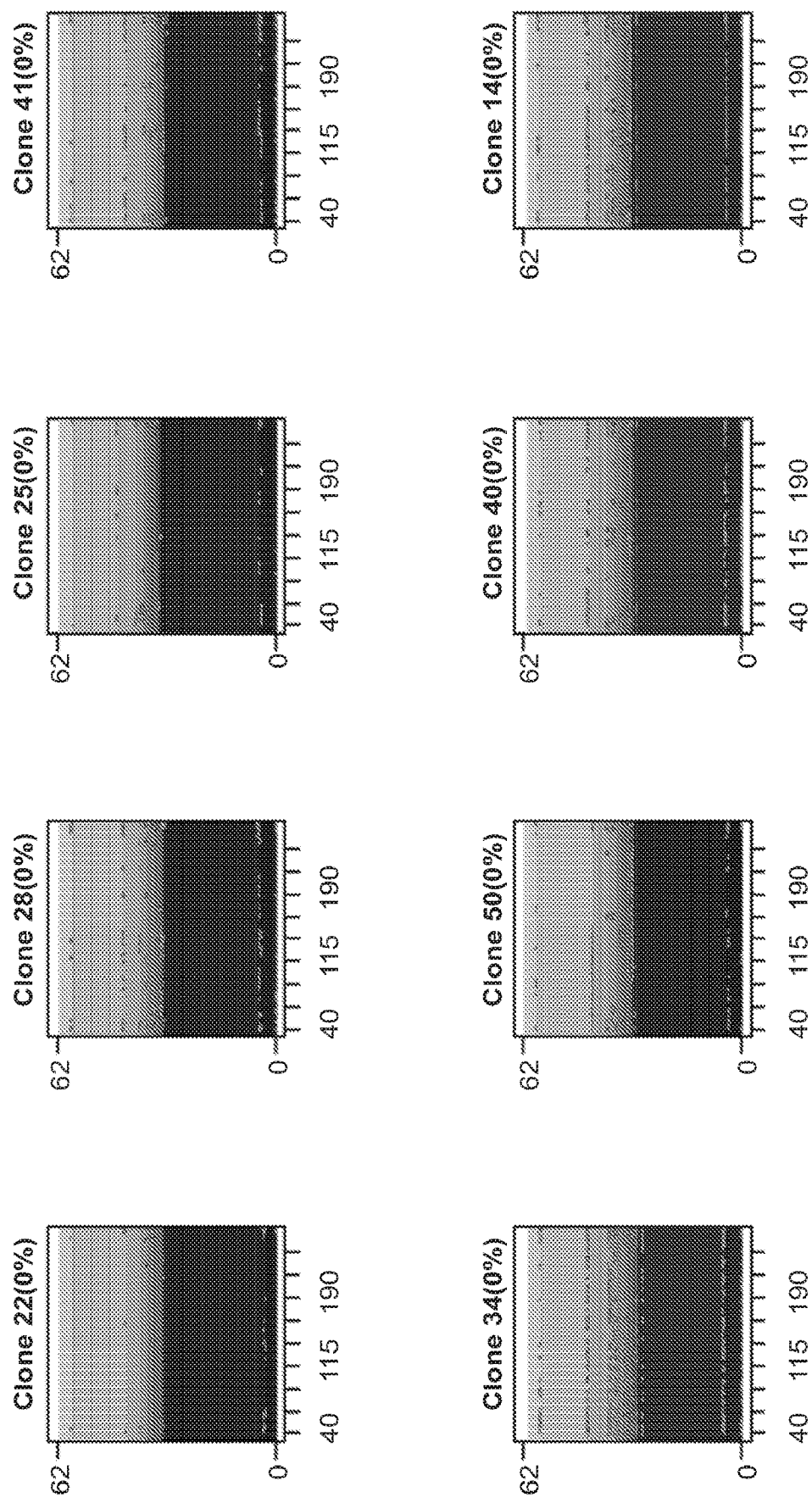
Figure 14:
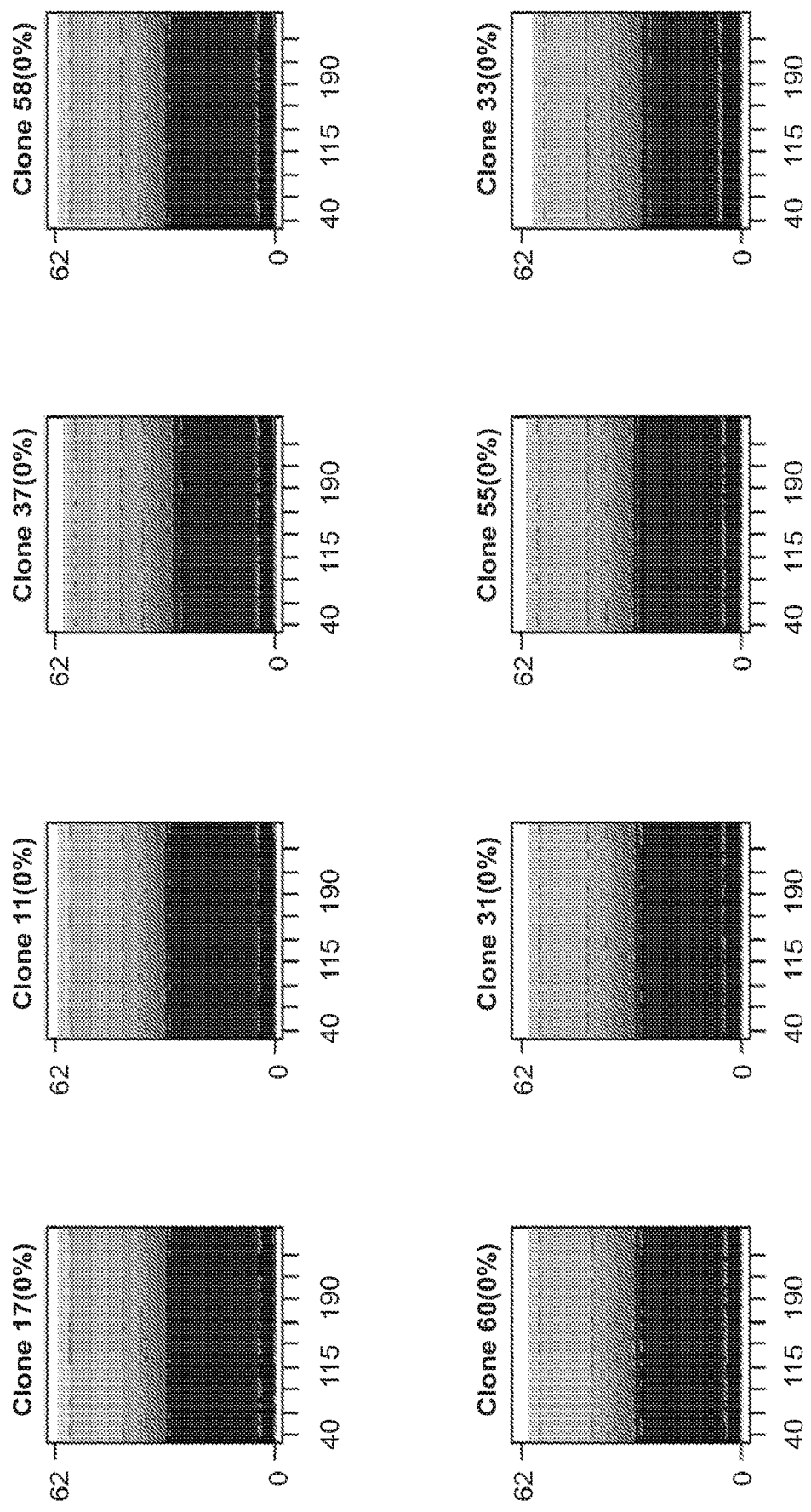
Figure 15A:
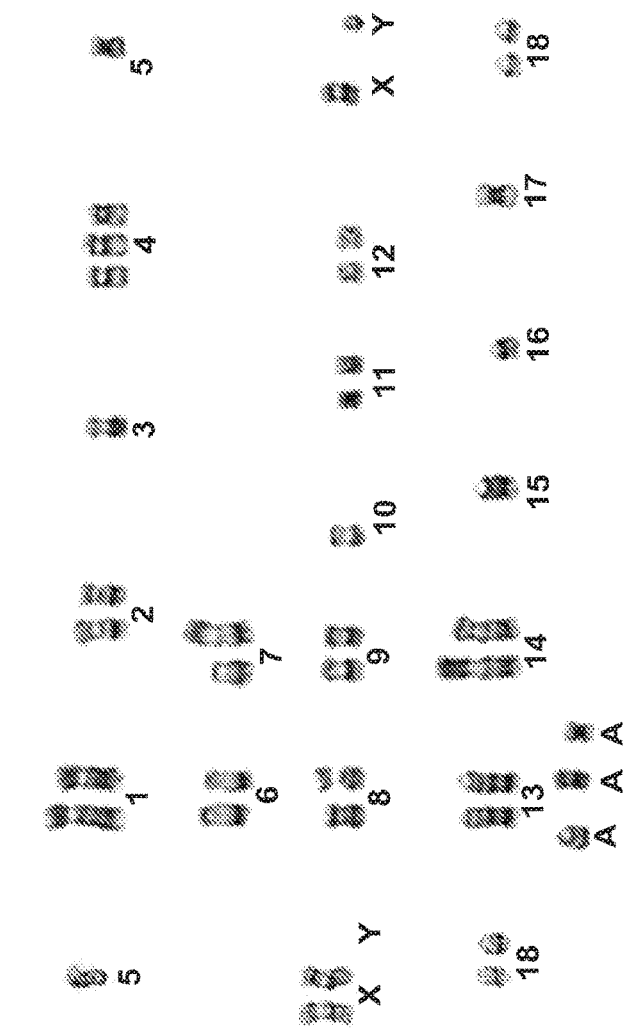
FIGS. 15A-15B (S12) illustrate karyotype analysis of highly and lowly modified PK15 clones.
Figure 15B:
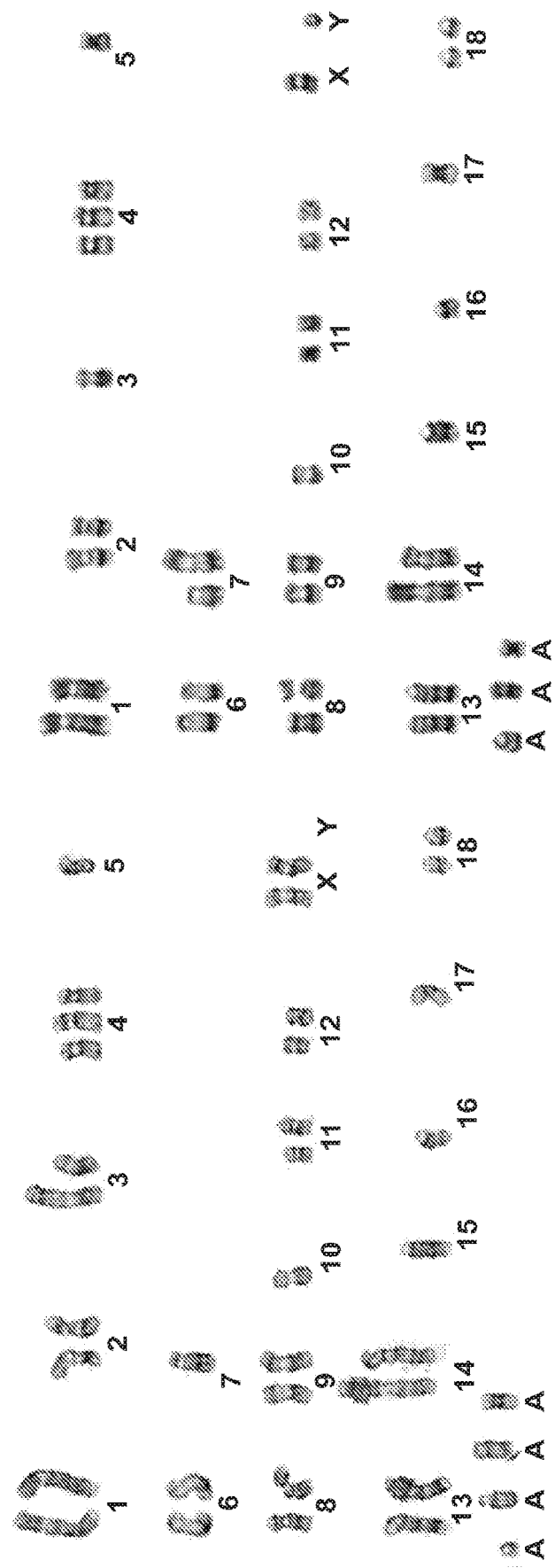
Figure 20A:
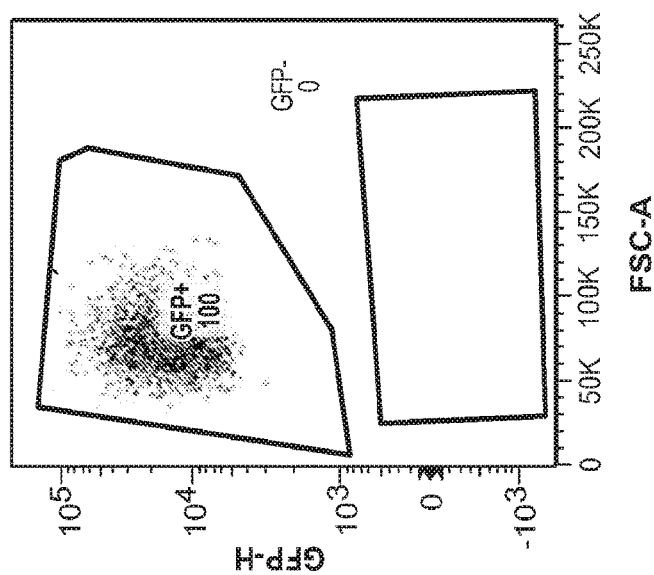
FIGS. 20A-20C (S17) illustrate quality control of the purified HEK293-GFP cells by FACS.
Figure 20B:
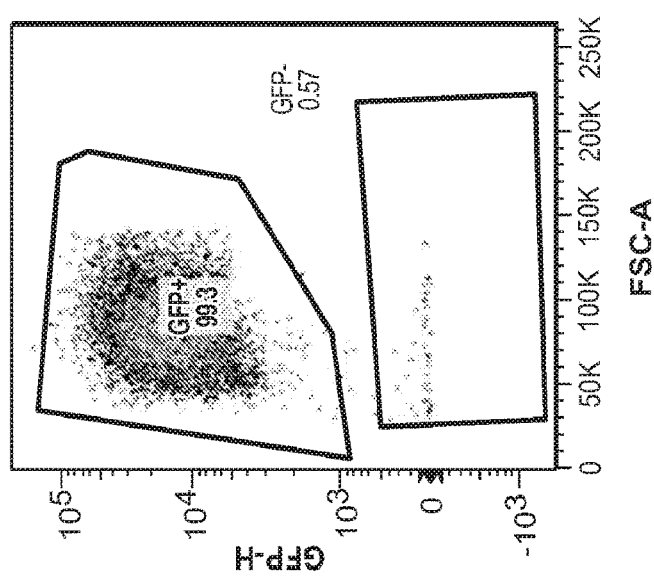
Figure 20C:
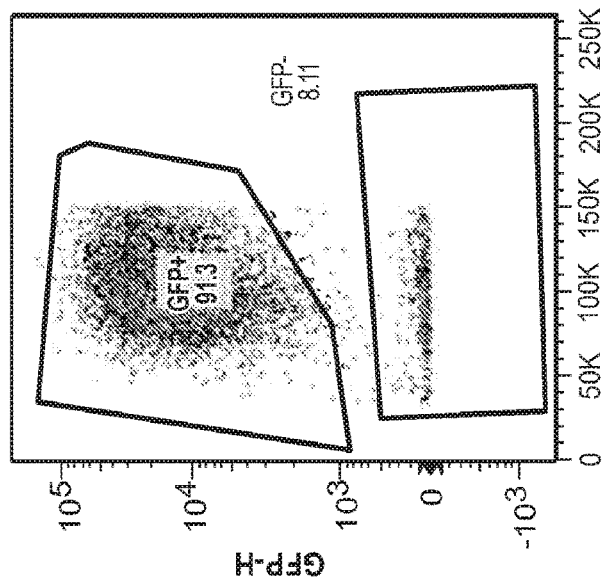
Figure 21A:
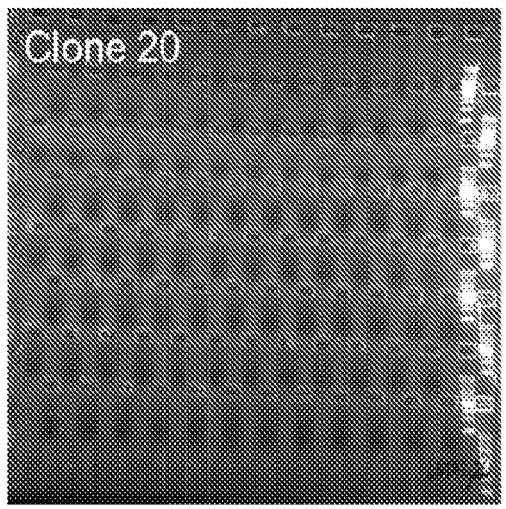
FIGS. 21A-21D (S18) illustrates detection of pig cell contamination in HEK293 cells using pig GGTA1 primers.
Figure 21B:
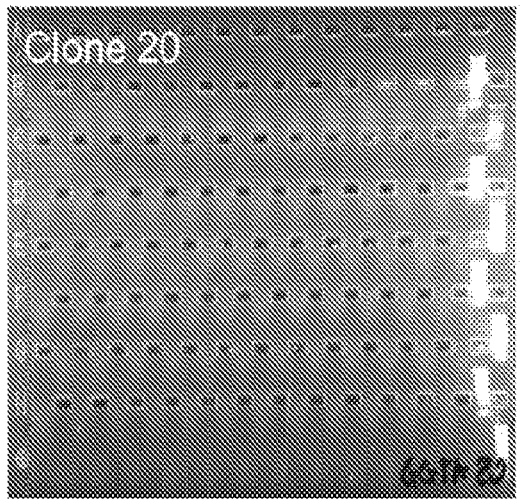
Figure 21C:
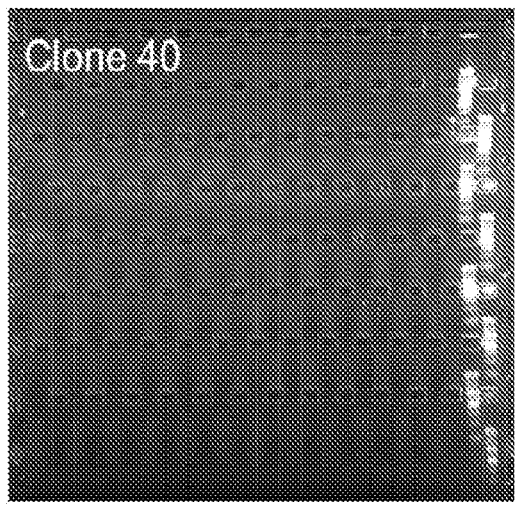
Figure 21D:
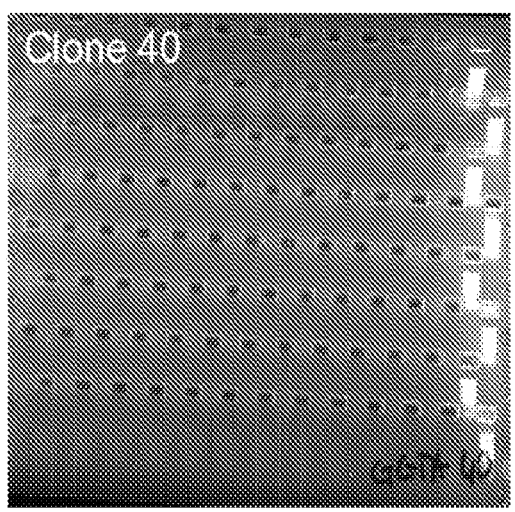
Figure 22A:
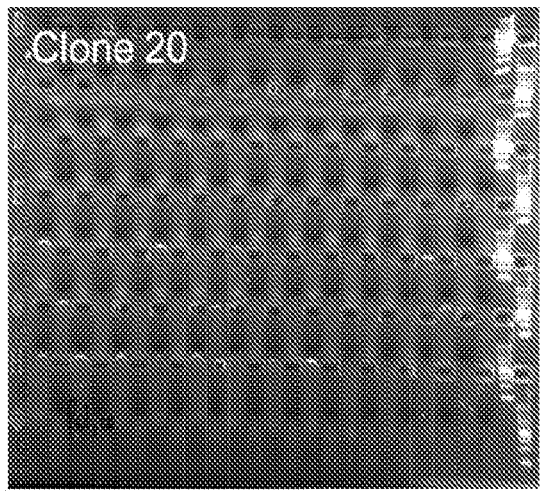
FIGS. 22A-22D (S19) illustrates detection of PERV DNA elements in HEK293 cells using PERV pol primers.
Figure 22B:
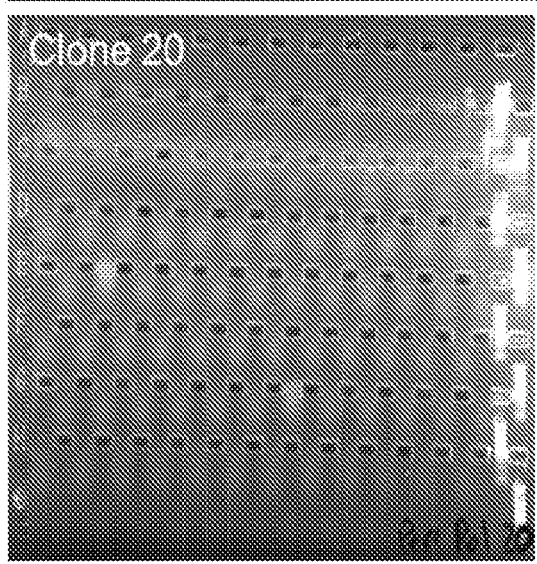
Figure 22C:
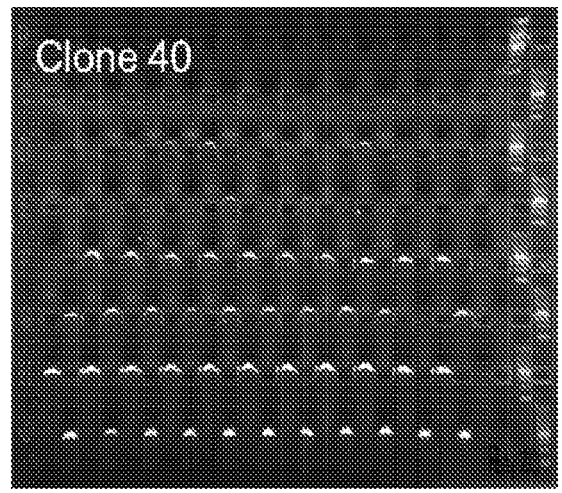
Figure 22D:
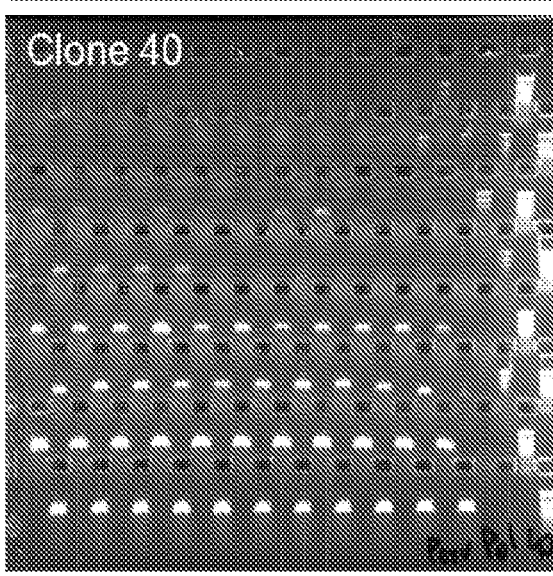
Figure 24A:
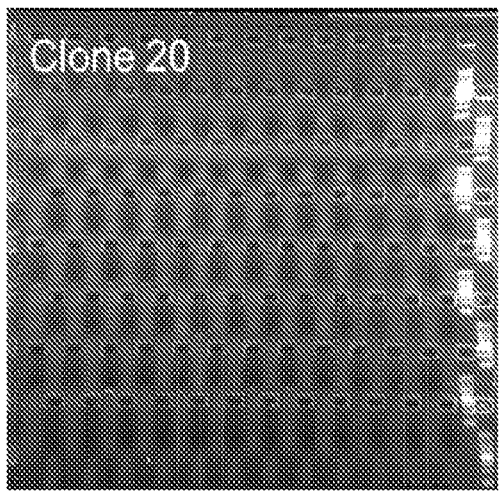
FIGS. 24A-24D (S21) illustrates detection of PERV DNA elements in HEK293 cells using PERV gag primers.
Figure 24B:
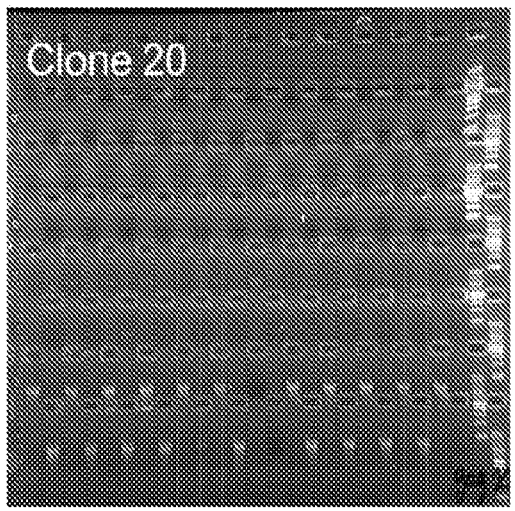
Figure 24C:
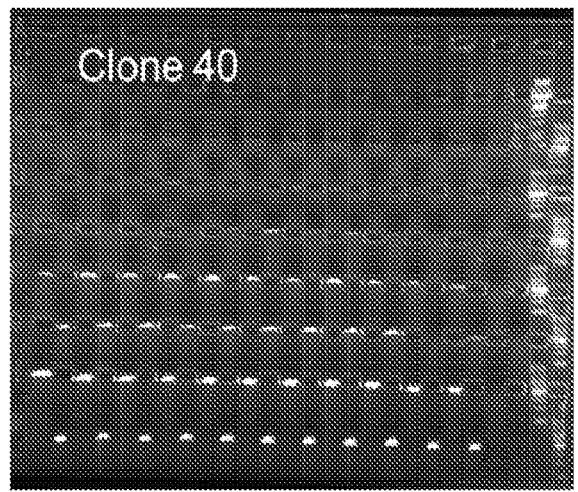
Figure 24D:
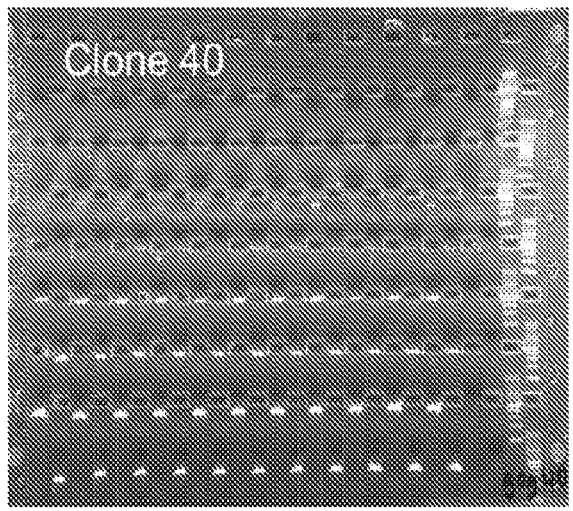
Figures 25A, 25B:
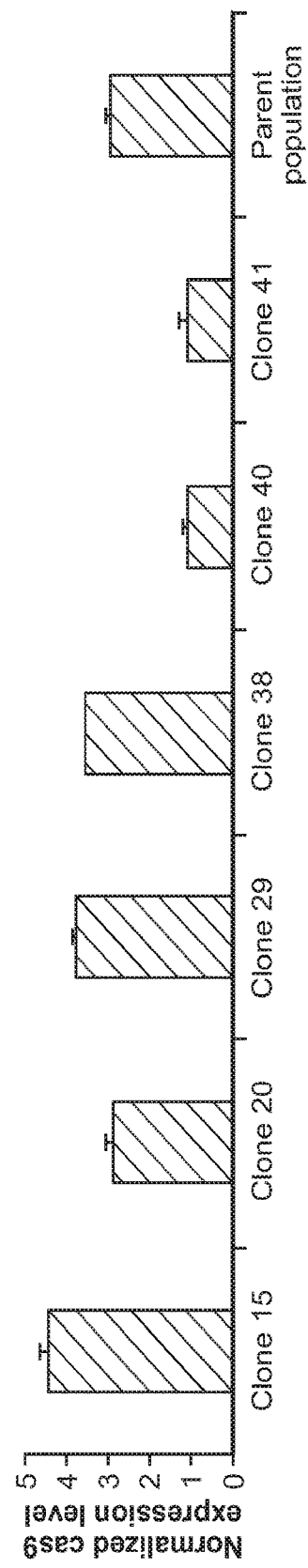
FIGS. 25A-25B (S22) illustrates Cas9/2gRNAs expression levels in highly and lowly modified clones.
Figure 26:
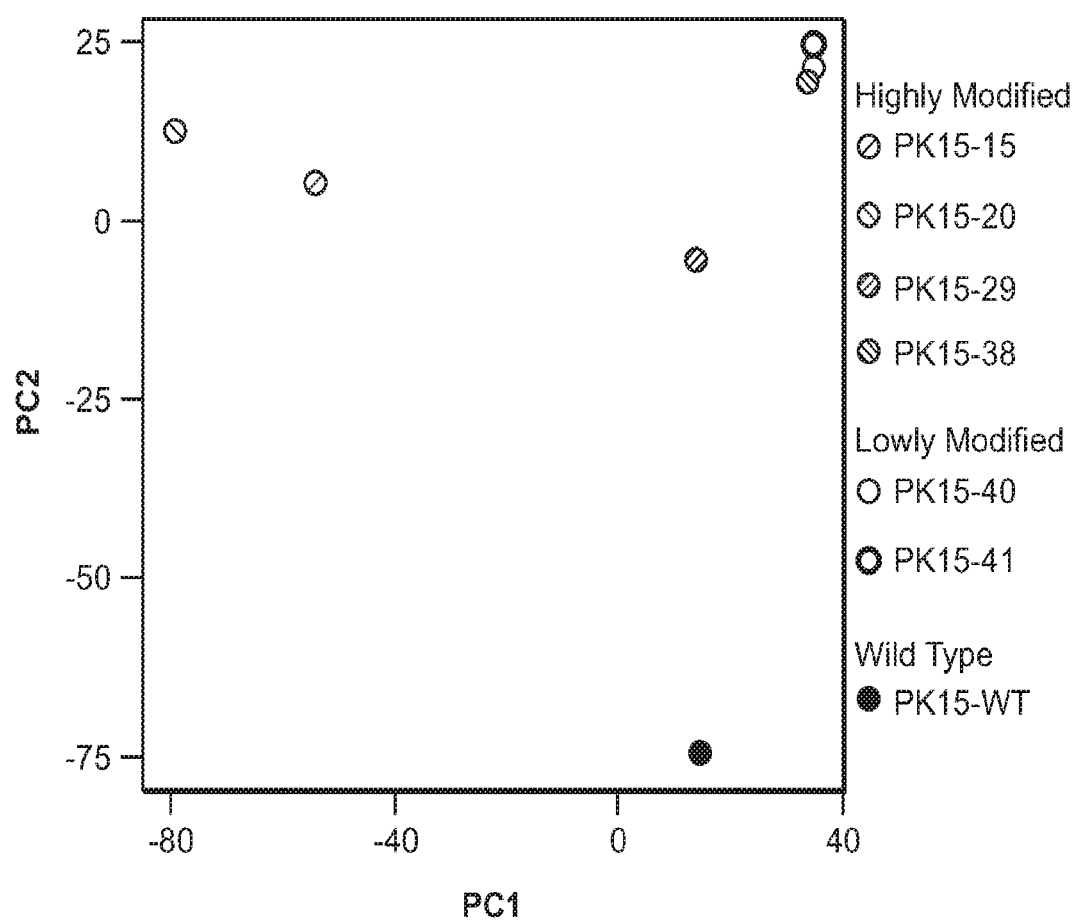
FIG. 26 (S23) illustrates principle component analysis of highly and lowly modified PK15 clones.
Figure 27A:
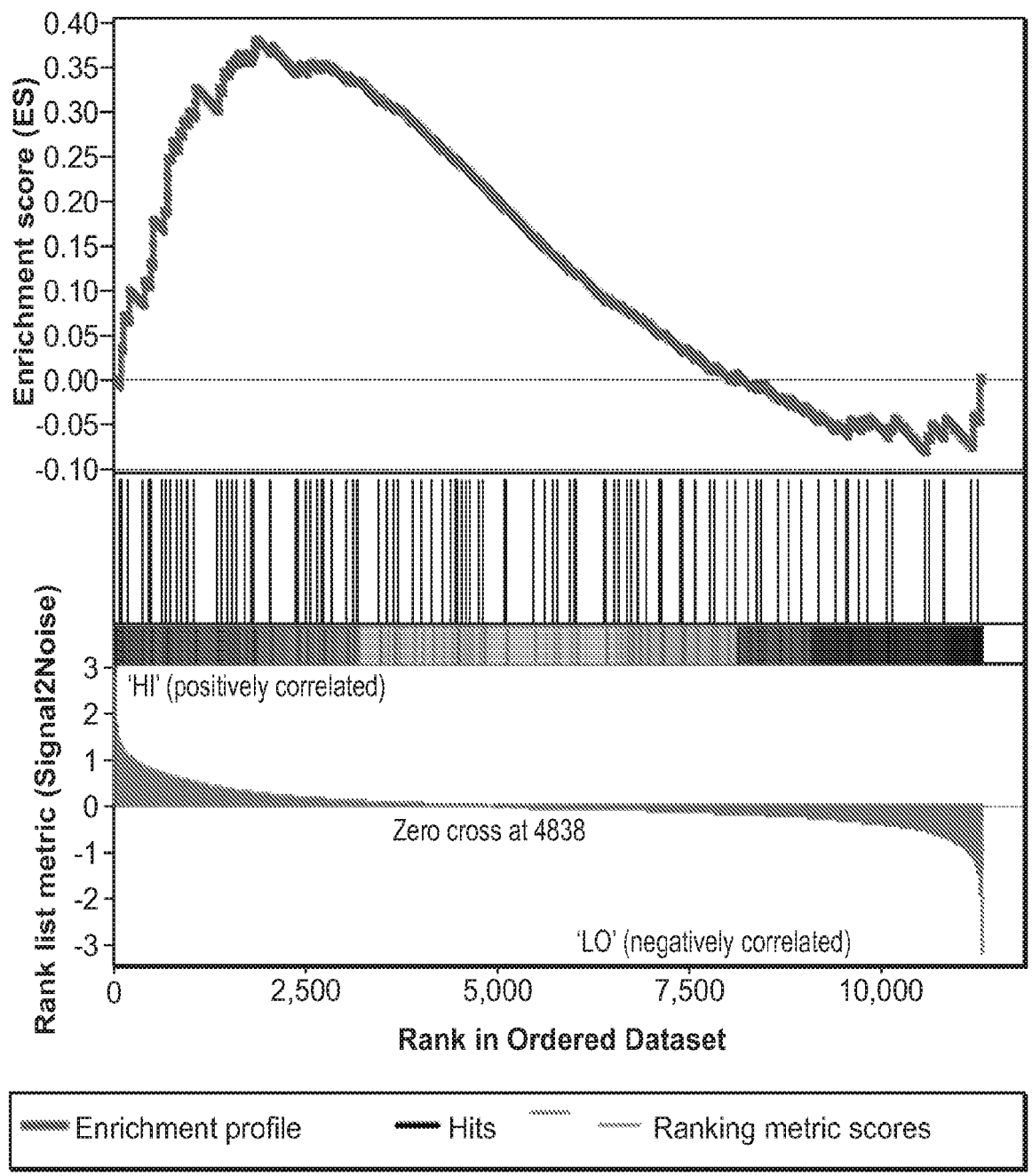
Figure 28:
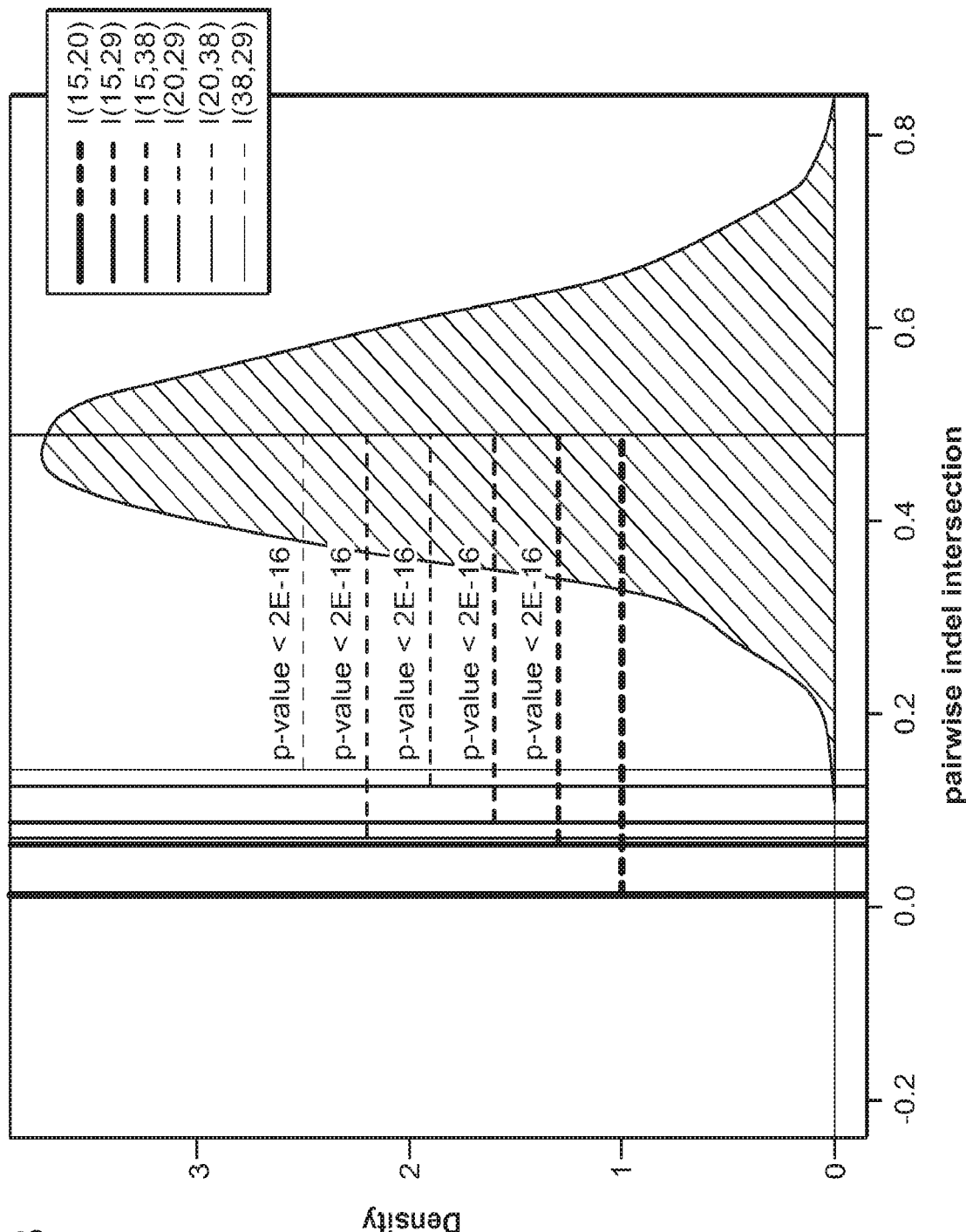
FIG. 28 (S25) illustrates indel composition analysis and comparison among highly modified clones.

Single cells from PK15 cells with high PERV targeting efficiency were sorted using flow cytometry and genotyped the pol locus of the resulting clones via deep sequencing. A repeatable bimodal (FIG. 2A, FIG. 11, and FIGS. 12A-12B) distribution was observed with ~10% of the clones exhibiting high levels of PERV disruption (97%-100%), and the remaining clones exhibiting low levels of editing (<10%). Individual indel events were examined in the genomes of these clones (FIG. 2B, FIG. 13, and FIG. 14). For the highly edited clones (Clone 20, 100%; Clone 15, 100%; Clone 29, 100%; Clone 38, 97.37%), only 16-20 unique indel patterns in each clone (FIG. 2B, FIG. 14) were observed. In addition, there was a much higher degree of repetition of indels within each clone than across the clones (FIG. 28), suggesting a mechanism of gene conversion in which previously mutated PERV copies were used as templates to repair wild-type PERVs cleaved by Cas9 (FIG. 2B, FIG. 28). Mathematical modeling of DNA repair during PERV elimination (FIGS. 29A-29D) and analysis of expression data (FIGS. 25A-25B, FIG. 26, and FIG. 27A-27B) supported this hypothesis and suggested that highly edited clones were derived from cells in which Cas9 and the gRNAs were highly expressed.

Figure 30:
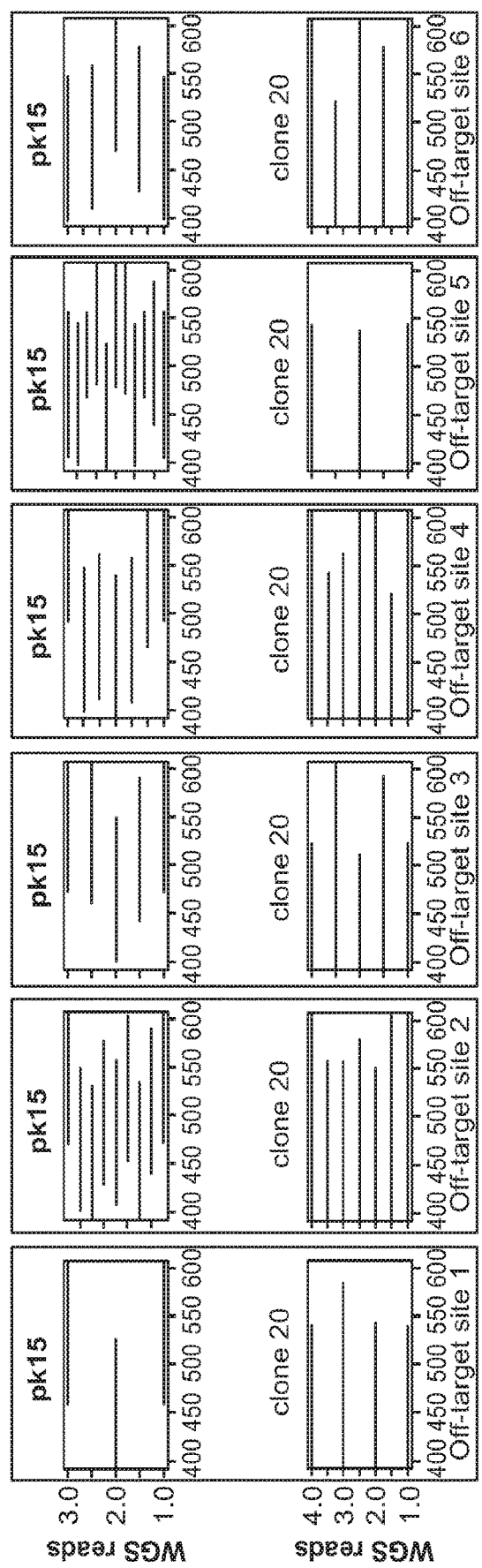
FIG. 30 (S27) illustrates off-target analysis using Whole Genome Sequencing (WGS).
Figure 30:
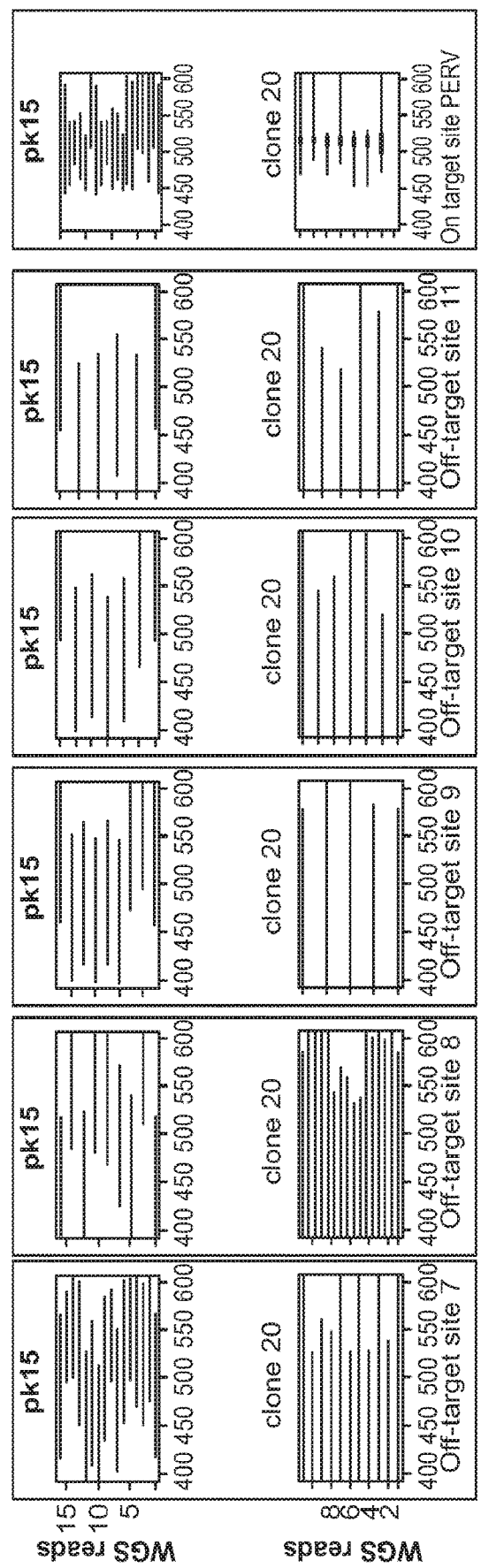

Next, unexpected genomic rearrangements had occurred as a result of the multiplexed genome editing was examined. Karyotyping of individual modified clones (FIGS. 15A-15B, FIG. 16, and FIG. 17) indicated that there were no observable genomic rearrangements. 11 independent genomic loci with at most 2 bp mismatches to each of the intended gRNA targets were examined and observed no non-specific mutations (FIG. 30). This suggests that our multiplexed Cas9-based genome engineering strategy did not cause catastrophic genomic instability.

Figure 3A:
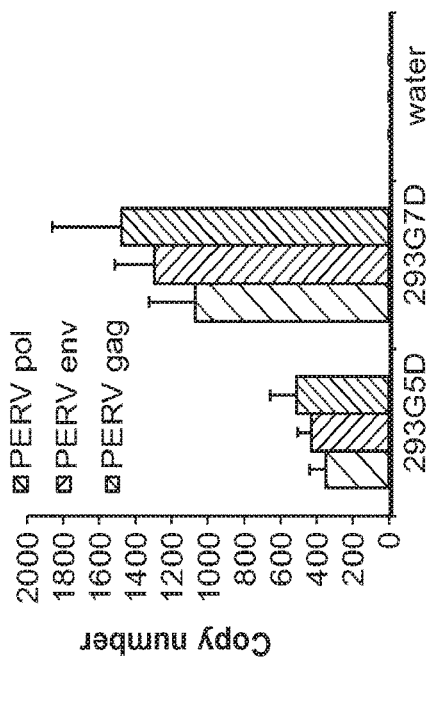
FIGS. 3A-3D illustrate: (A) Detection of PERV pol, gag, and env DNA in the genomes of HEK-293-GFP cells after co-culturing with PK15 cells for 5 days and 7 days (293G5D and 393G7D, respectively). A pig GGTA1 primer set was used to detect pig cell contamination of the purified human cells. (B) qPCR quantification of the number of PERV elements in 1000 293G cells derived from a population co-cultured with wild type PK15 cells using specific primer sets. (N=3, mean+/−SEM) (C) qPCR quantification of the number of PERV elements in PK15 Clones 15, 20, 29, and 38, with high levels of PERV pol modification, and minimally modified Clones 40 and 41. (N=3, mean+/−SEM) (D) Results of PCR on PERV pol on genomic DNA from various numbers of HEK 293-GFP cells (0.1, 1, 10, and 100) isolated from populations previously cultured with highly modified PK15 Clone 20 and minimally modified Clone 40. See FIGS. 21A-21D, FIGS. 22A-22D, FIGS 23A-23D and FIGS. 24A-24D for a full panel of PCR reactions.
Figure 3B:
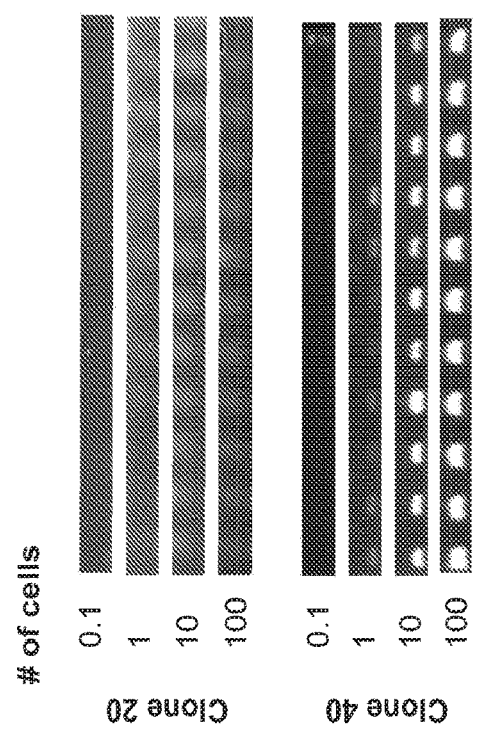
Figure 3C:
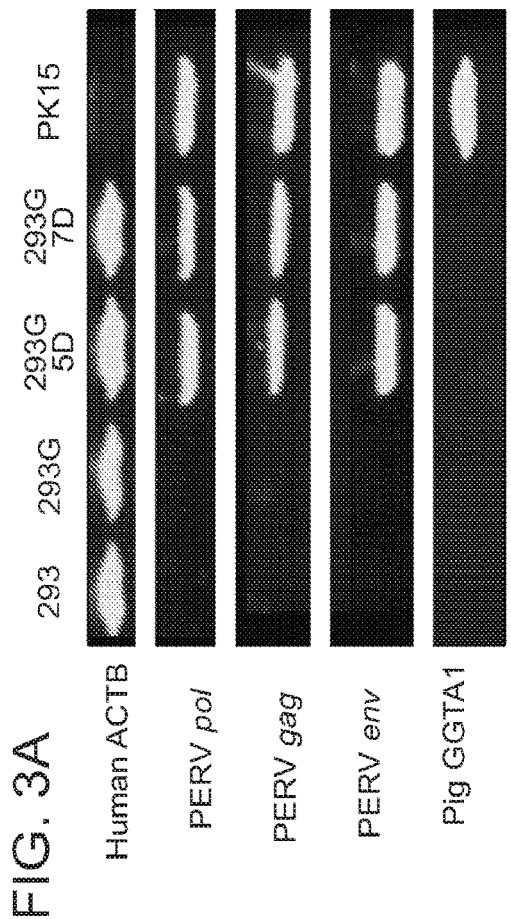
Figure 3D:
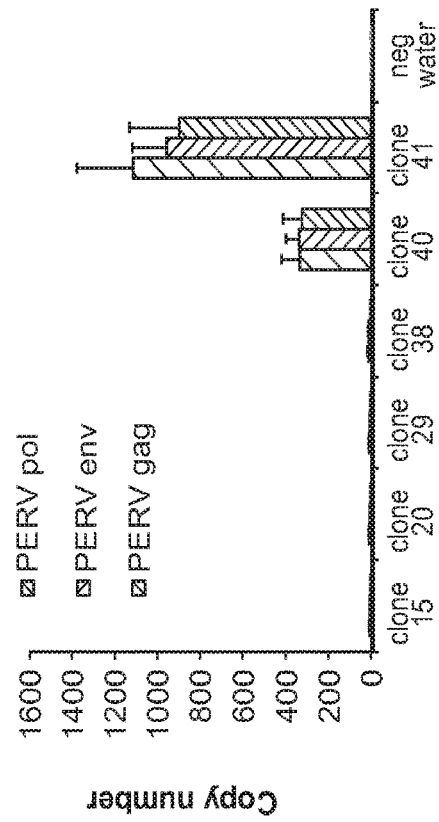

Last, disruption of all copies of PERV pol in the pig genome could eliminate in vitro transmission of PERVs from pig to human cells was examined. No detection of RT activity in the cell culture supernatant of the highly modified PK15 clones (FIG. 18) was observed, suggesting that modified cells only produced minimal amounts of PERV particles. Co-culture of WT and highly modified PK15 cells with HEK 293 cells were tested directly for transmission of PERV DNA to human cells. After co-culturing PK15 WT and HEK 293 cells for 5 days and 7 days (FIG. 19, FIGS. 20A-20C), PERV pol, gag, and env sequences in the HEK 293 cells were detected (FIG. 3A). The estimated frequency of PERV infection was approximately 1000 PERVs/1000 human cells (FIG. 3B). However, PK15 clones with >97% PERV pol targeting exhibited up to 1000-fold reduction of PERV infection, similar to background levels (FIG. 3C). These results were validated with PCR amplification of serial dilutions of HEK293 cells that had a history of contact with PK15 clones (FIG. 3D, FIGS. 21A-21D, FIGS. 22A-22D, FIGS. 23A-23D and FIGS. 24A-24D). PERVs in single HEK293 cells isolated from the population co-cultured with minimally modified Clone 40 was consistently detected, but could not distinctly detect PERVs in 100 human cells from the population co-cultured with highly modified Clone 20. Thus, PERV infectivity of the engineered PK15 cells had been reduced by up to 1000 fold.

In summary, it was successfully targeted the 62 copies of PERV pol in PK15 cells and demonstrated greatly reduced in vitro transmission of PERVs to human cells. While in vivo PERV transmission to humans has not been demonstrated, PERVs are still considered risky and our strategy could completely eliminate this. As no porcine embryonic stem cells exist, this system will need to be recapitulated in primary porcine cells and cloned into animals using somatic cell nuclear transfer. Moreover, simultaneous Cas9 targeting of 62 loci in single pig cells without salient genomic rearrangement was achieved. To our knowledge, the maximum number of genomic sites previously reported to be simultaneously edited has been six. Our methods thus open the possibility of editing other repetitive regions of biological significance.

Example 2. Methods

PERV copy number quantification: Droplet Digital PCR™ PCR (ddPCR™) was usd to quantify the copy number of PERVs according to the manufacturer's instructions (Bio-Rad). Briefly, genomic DNA (DNeasy Blood & Tissue Kit, Qiagen) from cultured cells was purified, digested 50 ng genomic DNA with MseI (10 U) at 37° C. for 1 hour, and prepared the ddPCR reaction with 10 µl 2× ddPCR Master mix, 1 µl of 18 µM target primers & 5 µM target probe (VIC), 10 of 18 µM reference primers & 5 µM reference probe (FAM), 5 ng digested DNA, and water to total volume of 20 µl. The sequence of the primers and the probe information can be found in Extended Data Table 1.

Methods

TABLE 1

Primers used in ddPCR assay

| Name | Sequence |
| --- | --- |
| PrimerPol1-FW | CGACTGCCCCAAGGGTTCAA (SEQ ID NO: 1) |
| PrimerPol2-FW | CCGACTGCCCCAAGAGTTCAA (SEQ ID NO: 2) |
| PrimerPol-RV | TCTCTCCTGCAAATCTGGGCC (SEQ ID NO: 3) |
| ProbePol | /56FAM/CACGTACTGGAGGAGGGTCACCTG (SEQ ID NO: 4) |
| Primerpig_actin_F | Taaccgatcctttcaagcattt (SEQ ID NO: 5) |
| Primerpig_actin_R | Tggtttcaaagcttgcatcata (SEQ ID NO: 6) |
| Probepig_actin | /5Hex/cgtggggatgcttcctgagaaag (SEQ ID NO: 7) |
| Primerpig_GAPDH_F | Ccgcgatctaatgttctctttc (SEQ ID NO: 8) |
| Primerpig_GAPDH_R | Ttcactccgaccttcaccat (SEQ ID NO: 9) |
| Probepig_GAPDH | /5Hex/cagccgcgtccctgagacac (SEQ ID NO: 10) |

CRISPR-Cas9 gRNAs design: MUSCLE was used to carry out a multiple sequence alignment of 245 endogenous retrovirus found in the porcine genome. A phylogenetic tree of the sequences was built and identified a clade that included the PERVs (see FIG. 1a). The R library DECIPHER was used to design specific gRNAs that target all PERVs but no other endogenous retroviral sequences.

Cell culture: PK15 were maintained in Dulbecco's modified Eagle's medium (DMEM, Invitrogen) high glucose supplemented with 10% fetal bovine serum (Invitrogen), and 1% penicillin/streptomycin (Pen/Strep, Invitrogen). All cells were maintained in a humidified incubator at 37° C. and 5% $CO_2$.

PiggyBac-Cas9/2gRNAs construction and cell line establishment: PiggyBac-Cas9/2gRNAs construct is derived from a plasmid previously reported in Wang et al (2). Briefly, a DNA fragment encoding U6-gRNA1-U6-gRNA2 was synthesized (Genewiz) and incorporated it into a PiggBac-Cas9 construct. To establish PK15 cell lines with PiggyBac-Cas9/2gRNAs integration, $5·10^5$ PK15 cells was transfected with 4 μg PiggyBac-Cas9/2gRNAs plasmid and 1 μg Super PiggyBac Transposase plasmid (System Biosciences) using Lipofectamine 2000 (Invitrogen). To enrich for the cells carrying the integrated construct, 2 μg/mL puromycin was added to the transfected cells. Based on the negative control, puromycin was applied to wild type PK15 cells, it was determined that the selection completed in 3 days. The PK15-PiggyBac cell lines were maintained with 2 μg/mL puromycin hereafter. 2 μg/ml doxycycline was applied to induce Cas9 expression.

Lentivirus-Cas9/2gRNAs construction and cell line establishment: Lenti-Cas9/2gRNAs constructs were derived from a plasmid previously reported (3). A DNA fragment encoding U6-gRNA1-U6-gRNA2 was synthesized (Genewiz) and incorporated it into a Lenti-Cas9-V2. To generate lentivirus carrying Lenti-Cas9/2gRNAs, $~5·10^6$ 293 FT HEK cells was transfected with 3 μg Lenti-Cas9-gRNAs and 12 μg ViraPower Lentiviral Packaging Mix (Invitrogen) using Lipofectamine 2000. The lentiviral particles were collected 72 hours after transfection, and the viral titer was measured using Lenti-X GoStix (Takara Clonetech). $~10^5$ lentiviral particles to $~1·10^6$ PK15 cells were transduced and conducted selection by puromycin to enrich transduced cells 5 days after transduction. The PK15-Lenti cell lines were maintained with 2 μg/mL puromycin thereafter.

Genotyping of colonized and single PK15 cells: PK15 cultures were dissociated using TrypLE (Invitrogen) and resuspended in PK15 medium with the viability dye ToPro-3 (Invitrogen) at a concentration of $1-2·10^5$ cells/ml. Live PK15 cells were single-cell sorted using a BD FACSAria II SORP UV (BD Biosciences) with 100 mm nozzle under sterile conditions. SSC-H versus SSC-W and FSC-H versus FSC-W doublet discrimination gates and a stringent '0/32/16 single-cell' sorting mask were used to ensure that one and only one cell was sorted per well. Cells were sorted in 96-well plates with each well containing 1000 μl PK15 medium. After sorting, plates were centrifuged at 70 g for 3 min. Colony formation was seen 7 days after sorting and genotyping experiment was performed 2 weeks after FACS.

To genotype single PK15 cells without clonal expansion, the PERV locus was directly amplified from sorted single cells according to a previously reported single cell genotyping protocol (4). Briefly, prior to sorting, all plastics and non-biologic buffers were treated with UV radiation for 30 min. Single cells were sorted into 96-well PCR plates with each well carrying 0.5 μl 10×KAPA express extract buffer (KAPA Biosystems), 0.1 μl of 1 U/μl KAPA Express Extract Enzyme and 4.6 μl water. The lysis reaction was incubated at 75° C. for 15 min and inactivated the reaction at 95° C. for 5 min. All reactions were then added to 250 PCR reactions containing 12.5 μl 2×KAPA 2G fast (KAPA Biosystems), 100 nM PERV illumina primers (Methods Table2), and 7.5 μl water. Reactions were incubated at 95° C. for 3 min followed by 25 cycles of 95° C., 10 s; 65° C., 20 s and 72° C., 20 s. To add the Illumina sequence adaptors, 50 of reaction products were then added to 20 μl of PCR mix containing 12.5 ml of 2 KAPA HIFI Hotstart Readymix (KAPA Biosystems), 100 nM primers carrying Illumina sequence adaptors and 7 μl water. Reactions were incubated at 95° C. for 5 min followed by 15-25 cycles of 98° C., 20 s; 65° C., 20 s and 72° C., 20 s. PCR products were checked on EX 2% gels (Invitrogen), followed by the recovery of 300-400 bp products from the gel. These products were then mixed at roughly the same amount, purified (QIAquick Gel Extraction Kit), and sequenced with MiSeq Personal Sequencer (Illumina). Deep sequencing data was analyzed and determined the PERV editing efficiency using CRISPR-GA (5).

TABLE 2

Primers used in the PERV pol genotyping

| Name | Sequence |
| --- | --- |
| illumina_primerPol1 | ACACTCTTTCCCTACACGACGCTCTTCCGATCTCGACTGCCCC AAGGGTTCAA (SEQ ID NO: 11) |
| illumina_primerPol2 | ACACTCTTTCCCTACACGACGCTCTTCCGATCTCCGACTGCCC CAAGAGTTCAA (SEQ ID NO: 12) |
| illumina_primerPo3 | GTGACTGGAGTTCAGACGTGTGCTCTTCCGATCTTCTCTCCTG CAAATCTGGGCC (SEQ ID NO: 13) |

Targeting efficiency estimation: a custom pipeline was built to estimate the efficiency of PERV inactivation. Briefly, the pol gene was amplified and sequenced via Illumina Next Generation Sequencing using PE250 or PE300. First, the two overlapping reads were combined using PEAR (6) and mapped to the reference region using BLAT. After mapping, the reads were grouped into sets containing specific combinations of haplotypes (see Extended Data FIG. 7), and indel types. Read sets with representation lower than 0.5% of the total number of mapped reads were discarded. Finally, the mapping output was parsed to call the different insertions and deletions as described in Güell et al (5).

RNA-seq analysis: The susScr3 pig genome and Ensembl transcripts were obtained from the UCSC Genome Brower Database. RNA-Seq reads were mapped to the reference genome using the STAR software (7) and the RPKM of the transcripts were quantified using BEDTools (8). Differential expression analysis was performed in R using the DESeq2 package (9), and gene set enrichment analysis was carried out by the GSEA software (10), with gene set definitions obtained from the software's website.

Reverse transcriptase (RT) assay: To test the RT activity of the PK15 cells and modified PK15 clones (4 highly and 1 lowly modified clones), $5 \cdot 10^5$ cells were plated in T75 cm² flasks, and collected the supernatant 4 days after seeding. The media was filtered using a 0.45 µM Millex-HV Syringe Filter (EMD Millipore Corporation), and the filtered supernatant was concentrated at 4000 g for 30 min using Amicon Ultra-15 Centrifugal Filter Unit (EMD Millipore Corporation). The concentrated supernatant was ultra-centrifuged at 50,000 rpm for 60 min. The supernatant was carefully removed, and the virus pellet was collected and lysed with 20 µl of 10% NP40 at 37° C. for 60 min.

The RT reaction was conducted using the Omniscript RT Kit (Qiagen). The total volume of the reaction was 20 µl, which contained 1 □ RT buffer, 0.5 mM dNTPs, 0.5 µM Influenza reverse primer (5' CTGCATGACCAGGGTT-TATG 3') (SEQ ID NO:14), 100 units of RnaseOUT (Life Technology, Invitrogen), 100 units of SuperRnase Inhibitor (Life Technologies), 5 µl of sample lysis and 40 ng of IDT-synthesized Influenza RNA template which was rnase resistant in both 5' and 3' end. The RNA template sequence was 5' rA*rA*rC*rA*rU*rGrGrArArCrCrUrUr-UrGrGrCrCrCrUrGrUrUrCrArUrUrUrUrArGrArAr ArUr-CrArArGrUrCrArArGrArUrArCrGrCrArGrArArGrAr-GrUrArGrArCrArUrArArArArCrCr CrUrGrGrUrCrArUrGrCrArGrArCrCrU*rC*rA*rG*rU*rG 3' (* phosphodiester bond) (SEQ ID NO:15). After the RT reaction was completed, the RT product was examined by PCR using Influenza forward (5' ACCTTTGGCCCTGTT-CATTT 3') (SEQ ID NO:16) and Influenza reverse primers (sequence shown as above). The expected size of the amplicon was 72 bp.

Infectivity Assay

HEK293-GFP cell line establishment: The Lenti-GFP construct was derived from the plasmid pLVX-IRES-Zs-Green1 (Clontech. Catalog No. 632187; PT4064-5). To generate the lentivirus carrying Lenti-GFP, ~$5 \cdot 10^6$ 293 FT HEK cells were transfected with 3 µg of pVX-ZsGreen plasmid and 12 µg of ViraPower Lentiviral Packaging Mix (Invitrogen) using Lipofectamine 2000 (Invitrogen). Lentiviral particles were collected 72 hours after transfection, and the viral titer was measured using Lenti-X GoStix (Takara Clonetech). ~$10^5$ lentivirus particles to ~$1 \cdot 10^6$ HEK293 cells were transfected and conducted selection by puromycin to enrich the transduced cells 5 days after transduction. The 293-GFP-Lenti cell lines were maintained with 0.5 µg/mL puromycin thereafter.

Infectivity test of PK15 WT to HEK293-GFP: $1 \cdot 10^5$ cells of Lenti-GFP-293FT HEK cells and $1 \cdot 10^5$ PK15 WT cells were cultured together in a 6-well plate. In parallel, $2 \cdot 10^5$ PK15 WT cells were cultured alone in another well as a control. The puromycin selection experiment was done by adding 5 µg/ml of the antibiotic for 7 days. The time point was determined when no viable cells in the control well and approximately 100% GFP positive cells in the experimental well as the time point when the puromycin selection was completed to purify lenti-GFP-293FT human cells. Cells from the 293FT HEK/PK15 WT co-culture were collected at different time periods. The genomic DNA was extracted using (DNeasy Blood & Tissue Kit, Qiagen) from cultured cells of the 293-GFP WT, PK15 WT and the co-cultured cells. The genomic DNA concentration was measured using a Qubit 2.0 Fluorometer (Invitrogen), and 3 ng from each sample was used as DNA template for PCR. In all, 1 µL of the genomic DNA were added to 25 µL of a PCR mix containing 12.5 µL 2× KAPA Hifi Hotstart Readymix (KAPA Biosystems) and 100 µM of primers as listed in Methods Table 3. Reactions were incubated at 95° C. for 5 min followed by 35 cycles of 98° C., 20 s; 65° C., 20 s and 72° C., 20 s. PCR products were visualized on EX 2% gels (Invitrogen) and observed for bands of 300-400 base pairs.

TABLE 3

A table exhibiting the primers used in the infectivity assay

| Name | Sequence |
| --- | --- |
| PERV pol-Forward | GGG AGT GGG ACG GGT AAC CCA (SEQ ID NO: 17) |
| PERV pol-Reverse | GCC CAG GCT TGG GGA AAC TG (SEQ ID NO: 18) |
| PERV env-Forward | ACC TCT TCT TGT TGG CTT TG (SEQ ID NO: 19) |
| PERV env-Reverse | CAA AGG TGT TGG TGG GAT GG (SEQ ID NO: 20) |
| PERV gag-Forward | CGC ACA CTG GTC CTT GTC GAG (SEQ ID NO: 21) |
| PERV gag-Reverse | TGA TCT AGT GAG AGA GGC AGA G (SEQ ID NO: 22) |
| Pig GGTA1-Forward | GGA GCC CTT AGG GAC CAT TA (SEQ ID NO: 23) |
| Pig GGTA1-Reverse | GCG CTA AGG AGT GCG TTC TA (SEQ ID NO: 24) |
| Human ACTB-Forward | GCC TTC CTT CCT GGG CAT GG (SEQ ID NO: 25) |
| Human ACTB-Reverse | GAG TAC TTG CGC TCA GGA GG (SEQ ID NO :26) |

Quantification of PERV copy numbers infected in HEK293-GFP cells: qPCR was performed to quantify the PERV copy number in HEK293-GFP cells. Genomic DNA of PK15 WT cells of different amounts was used as the template for the qPCR reactions. Reactions were conducted in triplicate using KAPA SYBR FAST qPCR Master Mix Universal (KAPA Biosystems). PERV pol, env, gag primers, human ACTB and pig GGTA1 primers (Methods Table 3) were added to a final concentration of 1 µM. Reactions were incubated at 95° C. for 3 min (enzyme activation) followed by 50 cycles of 95° C., 5 s (denaturation); 60° C., 60 s (annealing/extension). The logarithm of the genomic DNA amount linearizes with the quantification cycle (Cq). pol, gag, env primers were used to examine for presence of PERVs. Pig GGTA1 primers served to control for potential porcine genome contaminants in human cells after infection. All experiments were conducted in triplicate.

Infectivity Assay of the Modified PK15 clones to HEK293-GFP: $1 \cdot 10^5$ cells of HEK293-GFP cells and $1 \cdot 10^5$ cells of the high modified (15, 20, 29, 38) clones and low modified clones (40, 41) were co-cultured in a 6-well plate for 7 days. To isolate the HEK293-GFP cells in order to examine for PERV elements, the GFP positive cells were double sorted to purify the human cell populations.

To quantify the PERV infectivity of different clones to HEK293-GFP cells, both qPCR assays and PCR assays were conducted on series diluted HEK293-GFP cells after sorting. For the qPCR assays, the genomic DNA (DNeasy Blood & Tissue Kit, Qiagen) was extracted from double sorted HEK293-GFP cells. The genomic DNA concentration was measured using Qubit 2.0 fluorometer (Invitrogen). In all, 3 ng of the genomic DNA was added to 20 μL of KAPA SYBR FAST qPCR reaction (KAPA Biosystems) using PERV pol, env, gag and pig GGTA primers respectively (Extended Data Table 2). The qPCR procedure was performed as described above. For the series dilution assay, purified HEK293-GFP cells were sorted (1 cell/well, 10 cells/well, 100 cells/well, 1000 cells/well) into 96-well PCR plates for direct genomic DNA extraction and PCR reactions. Briefly, cells were sorted into 20 μL lysis reaction including 2 μL of 10×KAPA Express Extract Buffer, 0.4 μL of 1 U/μl KAPA Express Extract Enzyme and 17.6 μL of PCR-grade water (KAPA Biosystems). The reactions were then incubated at 55° C. for 10 min (lysis), then at 95° C. for 5 min (enzyme inactivation). Subsequently, the PCR master mix was prepared. In all, 2 μL of the genomic DNA lysis was added to 4 different 25 μL of KAPA Hifi Hotstart PCR reactions (KAPA Biosystems) using 1 μM PERV pol, env, gag primers, and pig GGTA primers, respectively (Extended Data Table 2). The reactions were incubated at 95° C. for 3 min (initial denaturation) followed by 35 cycles of 95° C., 15 s (denaturation); 60° C., 15 s (annealing), 72° C., 15 sec/kb, then 75° C., 1 min/kb (final extension). (KAPA Biosystems). The PCR products were visualized on 96 well E-Gel® Agarose Gels, SYBR® Safe DNA Gel (Invitrogen).

CRISPR-Cas9 off-target analysis: whole genome sequencing (WGS) data was obtained for PK15 (untreated cell line) and clone 20 (highly edited clone). To investigate potential off-target effects of the Cas9/2gRNAs, the reference sequence (Sus Scrofa 10.2) was searched for sites that differed from the 20 bp sequences targeted by the two gRNAs by only 1 or 2 bp. 11 such sites were identified and extracted them, together with 200 bp of their neighboring regions (FIG. 4). BLAT was used to map the WGS reads to the extracted reference sequences and searched for potential indel patterns that had emerged in Clone 20 as a result of off-target effects. An average coverage of 7-8× per loci was obtained. Reads with <50 bp matches with the reference sequence were excluded. In case of reads that mapped to the reference sequence with multiple alignment blocks, which could indicate the presence of indels, reads whose alignment blocks contained <20 bp matches were excluded with the reference sequence. After inspecting the remaining mapped reads, there was no detection any off-target indel patterns present in clone 20. Another challenge was to comprehensive searches for off-targets here is that the Sus Scrofa genome is still neither complete nor completely assembled, limiting the ability to do whole-genome analysis.

Mathematical model of DNA repair process interaction during cumulative PERV inactivation: In this study PERV elements were inactivated by mutations generated by DNA repair processes in response to dsDNA cuts created by Cas9. It is generally understood that dsDNA cuts may be repaired either by non-homologous end joining (NHEJ) or Homologous Repair (HR), and that while HR can create precise copies of a DNA template sequence at the cut site given the presence of a template with suitable homology arms, NHEJ can generate mutations (especially indels) and is often considered "error prone." However, there is also evidence that NHEJ can also repair dsDNA cuts highly accurately (11, 12), and the relative rates of mutated vs. perfect repair by NHEJ have never been precisely measured. Especially when efficient targeted nucleases such as Cas9 are expressed for protracted time periods, perfect repair of a cut site by either NHEJ or HR would regenerate a target site that could be cut again. A plausible hypothesis is that the process of perfect repair and re-cutting would occur repeatedly until a mutation arose that destroyed the nuclease's ability to recognize the target site. To explore the way these repair modalities might work together during the course of PERV elimination, their interactions as a Markov process was modeled. Specifically, it was assumed:

There are N identical copies of the nuclease target in a cell.

Only wild-type targets are recognized and cut, and only one target is cut and repaired at a time.

DNA repair is either
  perfect restoration of the target site by NHEJ (with probability n)
  NHEJ that results in generation of a mutation that ablates target recognition (with probability m)
  repair by HR using any one of the other N−1 target sequences in the cell (with probability h)

Thus, n+m+h=1.

The Markov model computes the probability distribution $P^{(c)}=(p_0^{(c)}, p_1^{(c)}, \ldots, p_N^{(c)})$, where $p_i^{(c)}$ is the probability that there are i target-ablating mutations at cut c, where c=0, 1, 2 . . . . It is assumed that the initial condition $P^{(0)}=(1, 0, \ldots, 0)$, i.e., that all targets begin as wild-type. The N+1-by-N+1 transition matrix M is given as $$\left. \begin{array}{l} M(i, i) = n + h \cdot \dfrac{N-i-1}{N-1} \\ M(i, i+1) = m + h \cdot \dfrac{i}{N-1} \end{array} \right\} \text{ for } 0 \leq i < N$$

$$M(N, N) = 1 \text{ for } i = N$$

$$M(i, j) = 0 \text{ for all other } 0 \leq i, j \leq N$$

Finally, $P^{(c+1)}=P^{(c)}M$ for c=0, 1, 2, . . .

The formulas for M assume proposition ii above and state in mathematical terms that the number of mutated sites in a cell remains unchanged whenever a cut at a wild-type site is repaired perfectly by NHEJ or by HR using another copy of the wild-type template (formula for M(i, i)), but increases by one if the cut is repaired by mutagenic NHEJ or by HR using a previously mutated site (formula for M(i, i+1)).

The model incorporates two notable simplifications to actual biology: (i) Target recognition is assumed to be binary—either the nuclease recognizes a target or it does not. This is tantamount to assuming that small mutations that still support target recognition do not substantially alter wild-type cutting rates and therefore can be effectively lumped together with wild-type sites. (ii) HR repairs using mutated vs. wild-type templates are assumed to be equally efficient. Modifications could be made to the model to address these simplifications, but this is not considered here. It is also worth noting that, formally, given assumption ii above, the Markov process should actually stop should the condition $p_N^{(c)}=1$ be reached for some value of c, since at this point no wild-type sites remain to be cut, whereas what happens instead mathematically is that cuts continue but the model remains in a fixed state. Finally, the model effectively represents the mutation count distribution as a function of independent variable c (number of cuts) and not as a function of time. No prediction is made regarding the time rates of DNA repair or PERV site elimination, although time can be assumed to increase monotonically with c.

To analyze PERV elimination through the Markov model, N was always set to 62. However, since the relative efficiencies of perfect vs. mutagenic NHEJ repair are unknown (as noted above), and because relative rates of mutagenic NHEJ vs. HR repair can vary widely depending on cell state and type, the mutation count distributions for a discrete grid covering the complete two-dimensional space of all possible parameter values for n, m, and h, (2500 parameter combinations in all) was computed. The model was implemented both as a MatLab (Mathworks, Waltham) script and as an R script using the library markovchain (available as Supplemental Files modelMarkov.m, modelMarkov.R, respectively).

Figure 29A:
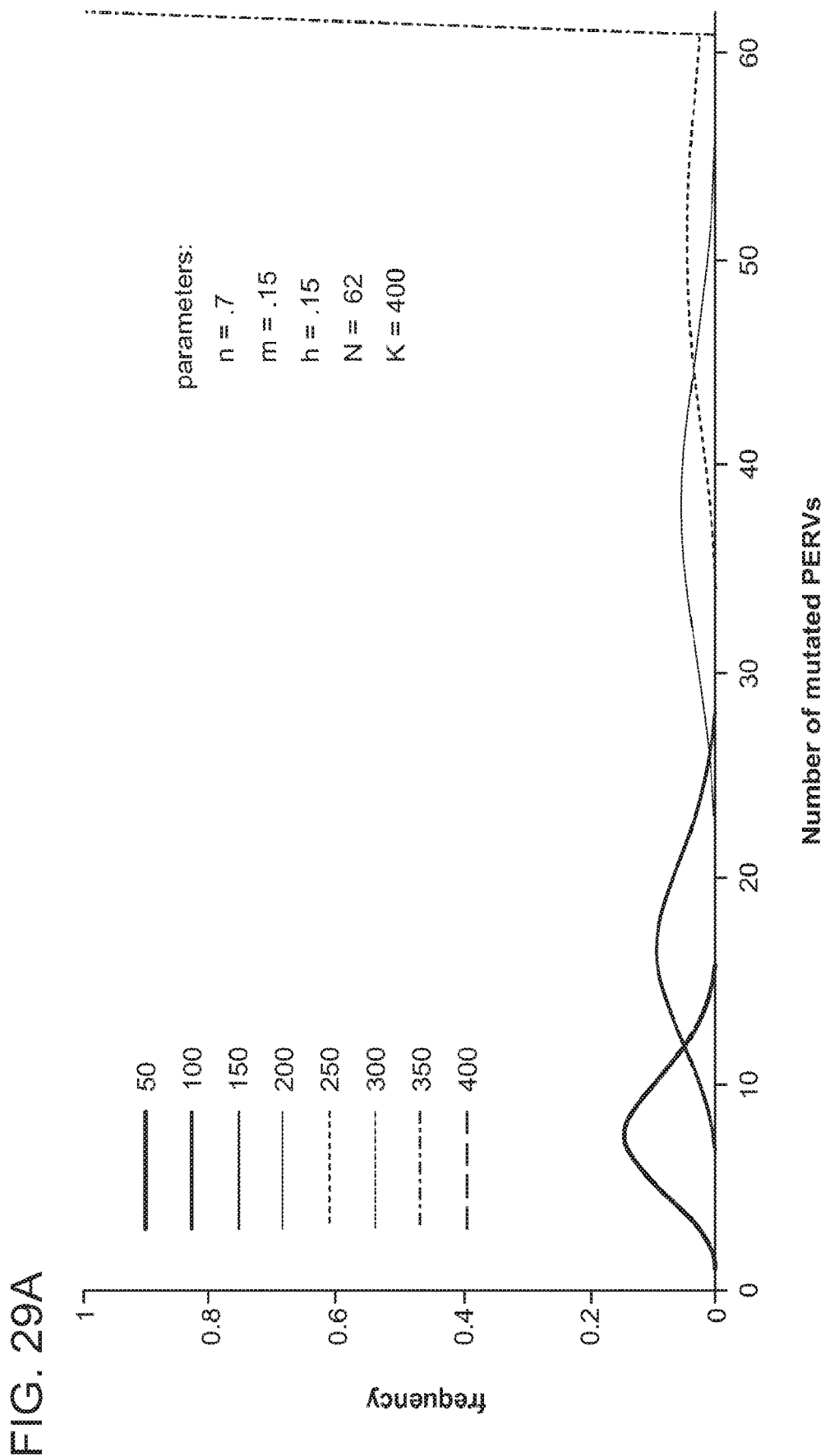
Figure 29C:
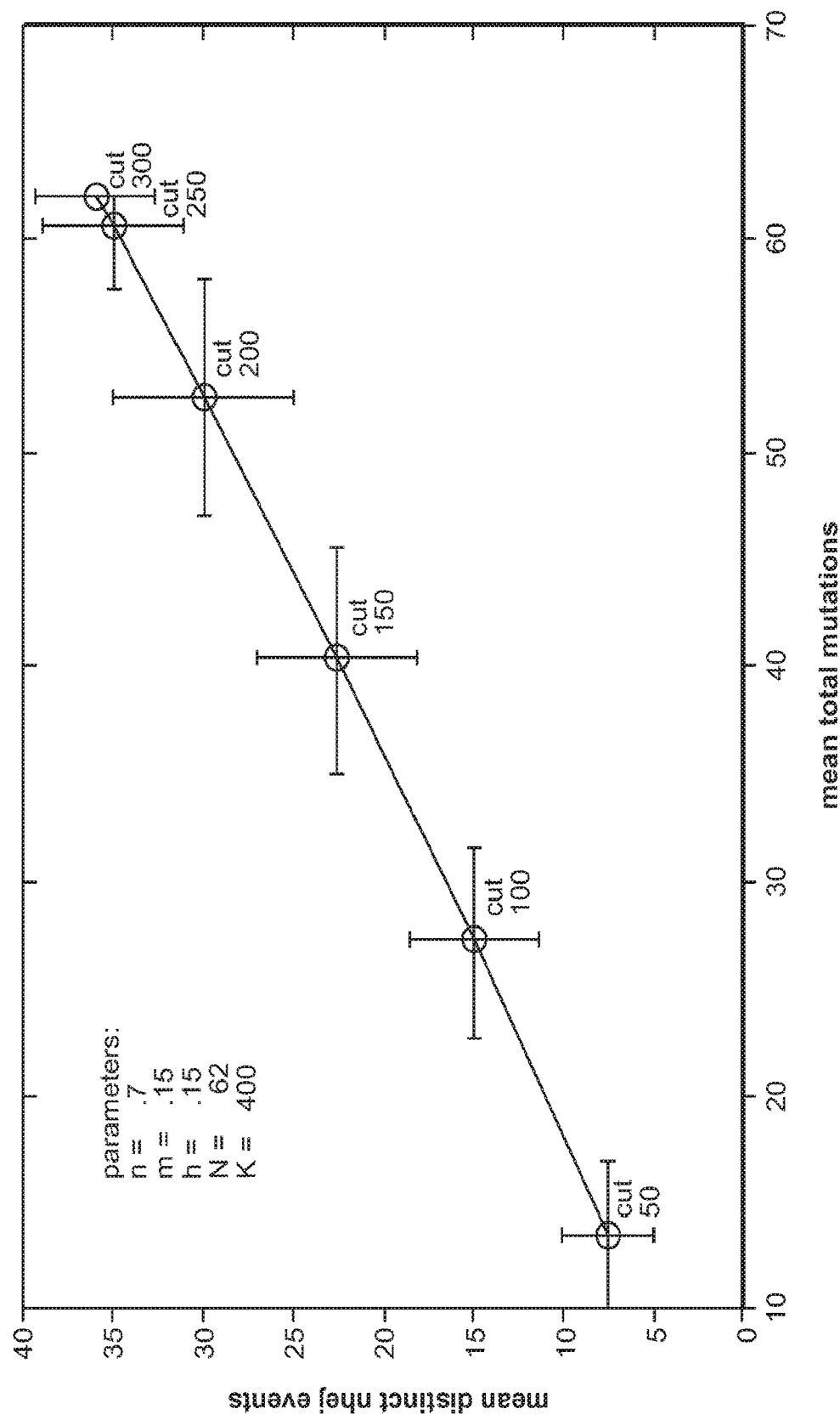
Figure 29D:
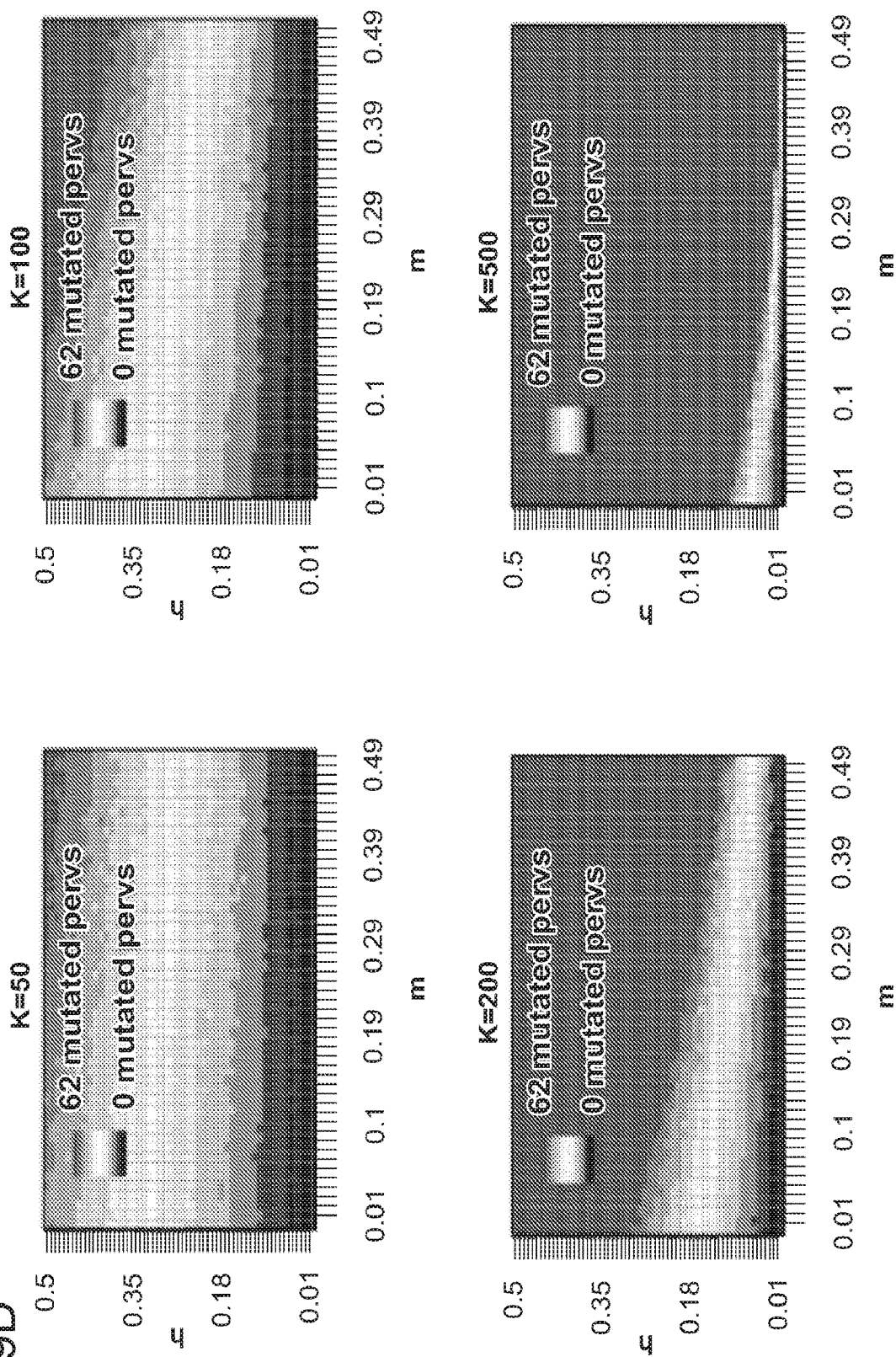

In addition to computing the mutation count distribution via the Markov model for particular parameter values, the MatLab script performed random simulations of the NHEJ and HR repair processes throughout a series of K cuts, allowing bivariate distributions of the numbers of total mutations vs. distinct NHEJ events to be estimated, illustrated in FIGS. 29B-29C. The R script was used to estimate the most likely state of the system over the grid of n, m, and h combinations described above. K was varied depending on the computation. As illustrated in FIG. 30, the invariable result of the model was a unimodal distribution of mutation counts whose mean advanced towards fixation at N mutations with c, and in FIGS. 29B-29C, K was set to a value high enough to demonstrate fixation. For the calculation of the most likely state of the system over the n, m, and h grid, K was set to 50, 100, 200, or 500, and 100 simulations were conducted for each parameter combination.

Data Deposition

Illumina Miseq data with PERVs elements genotyping data has been uploaded to the European Nucleotide Archive (ENA) hosted by the European Bioinformatics Institute (EBI) with the submission reference PRJEB11222.

Appendix A provide further information regarding various aspects of the present teachings, which is herein incorporated by reference in its entirety.

The DNA sequence listing further includes genome sequences of multiple endogenous retroviral elements extracted from pig genome sequence and from public sequence databases. (SEQ ID NO:30-280)

The teachings of all patents, published applications and references cited herein are incorporated by reference in their entirety.

While this invention has been particularly shown and described with references to example embodiments thereof, it will be understood by those skilled in the art that various changes in form and details may be made therein without departing from the scope of the invention encompassed by the appended claims.

SEQUENCE LISTING (280 sequences)

SEQ ID NO: 1 - DNA, 20 bp, Artificial
  primer
cgactgccccaagggttcaa

SEQ ID NO: 2 - DNA, 21 bp, Artificial
  primer
ccgactgccccaagagttcaa

SEQ ID NO: 3 - DNA, 21 bp, Artificial
  primer
tctctcctgcaaatctgggcc

SEQ ID NO: 4 - DNA, 24 bp, Artificial
  primer
cacgtactggaggagggtcacctg

SEQ ID NO: 5 - DNA, 22 bp, Artificial
  primer
taaccgatcctttcaagcattt

SEQ ID NO: 6 - DNA, 22 bp, Artificial
  primer
tggtttcaaagcttgcatcata

SEQ ID NO: 7 - DNA, 23 bp, Artificial
  primer
cgtggggatgcttcctgagaaag

SEQ ID NO: 8 - DNA, 22 bp, Artificial
  primer
ccgcgatctaatgttctctttc

SEQ ID NO: 9 - DNA, 20 bp, Artificial
  primer
ttcactccgaccttcaccat

SEQ ID NO: 10 - DNA, 20 bp, Artificial
  primer
cagccgcgtccctgagacac

SEQ ID NO: 11 - DNA, 53 bp, Artificial
  primer
acactctttccctacacgacgctcttccgatctcgactgccccaagggttcaa

SEQ ID NO: 12 - DNA, 54 bp, Artificial
  primer
acactctttccctacacgacgctcttccgatctccgactgccccaagagttcaa

SEQ ID NO: 13 - DNA, 55 bp, Artificial
  primer
gtgactggagttcagacgtgtgctcttccgatcttctctcctgcaaatctgggcc

SEQ ID NO: 14 - DNA, 20 bp, Artificial
  primer
ctgcatgaccagggtttatg

SEQ ID NO: 15 - RNA, 90 nt, Artificial
  primer
aacauggaaccuuuggcccuguucauuuuagaaaucaagucaagauacgcagaagaguagacauaaacccuggucaugcagaccucagug

SEQ ID NO: 16 - DNA, 20 bp, Artificial
  primer
acctttggccctgttcattt

SEQ ID NO: 17 - DNA, 21 bp, Artificial
  primer
gggagtgggacgggtaaccca

SEQ ID NO: 18 - DNA, 20 bp, Artificial
  primer
gcccaggcttggggaaactg

SEQ ID NO: 19 - DNA, 20 bp, Artificial
  primer
acctcttcttgttggctttg

SEQ ID NO: 20 - DNA, 20 bp, Artificial
  primer
caaaggtgttggtgggatgg

SEQ ID NO: 21 - DNA, 21 bp, Artificial
  primer
cgcacactggtccttgtcgag

SEQ ID NO: 22 - DNA, 22 bp, Artificial
  primer
tgatctagtgagagaggcagag

SEQ ID NO: 23 - DNA, 20 bp, Artificial
  primer
ggagcccttagggaccatta

SEQ ID NO: 24 - DNA, 20 bp, Artificial
  primer
gcgctaaggagtgcgttcta

SEQ ID NO: 25 - DNA, 20 bp, Artificial
  primer
gccttccttcctgggcatgg

SEQ ID NO: 26 - DNA, 20 bp, Artificial
  primer
gagtacttgcgctcaggagg

SEQ ID NO: 27 - DNA, 81 bp, Artificial
  pam sequence
ggacctggccaacttcaggatccaacaccctcaggtgaccctcctccagtacgtggatgacctgcttctggcgggagccac

SEQ ID NO: 28 - DNA, 81 bp, Artificial
  pam sequence
gtggctcccgccagaagcaggtcatccacgtactggaggagggtcacctgagggtgttggatcctgaagttggccaggtcc

SEQ ID NO: 29 - DNA, 83 bp, Artificial
  PERV sequence
ggacctggccaacttcaggatccaacaccctcaggtgaccctcctcccagttacgtggatgacctgcttctggcgggagccac

SEQ ID NO: 30 - DNA, 10330 bp, Artificial
  ss253 sequence
tgtaatgggtgtccgctcctgggagggtgaaccactgcctttcaggctggaaatagtccaaaatagtcagcttgccaccaaccagccatttggtctcttggagggataaaccatactggggctcagagtggtttctgttgccagcaggtgggacattcagaggcaaaaaagctgggatgaatccttaaagtagaggcaattctgatgggtccctgtgcatctctcatgccatccctgtttccatcagagccagctctggggtagcccgtgatgaaagttaatggatcaccctctatcttattatattattattatgcctcttctgtggtgactgacctggggtgggtattaacgtatgacccagaatctccacactttgtgcccatgccatatggacatcccgttgctgaggaatgtagtcagtattgtctttctggataagtaaatgctaaaaaaaatccagctttatacaaagttgagtagtccaaggtgaaggacatttgcctgggccttgttaacatttcttagctcaggacataggcctgggcctcgttaactttccacagggccggtgtaatgtaatcagcctggcacctaagtctctggcctcagcccccttccttagaagaacaaagttagctgataagggggactgcagatgctacaaggttacccatctaattacctctttggcgctggcagaagatgccggcttgaaagtcggaaaatatggcccttactataaatcattattgttaacctaaactctattcttagttaaggtttgaagcaatttgactgctgctttgcttttgcgtccctgcttatgcatgtgcacccctccccacctggatgtaagtttgcctttgtaaatgcggtcggtttcttagttgggagcttcacactcaagccgcttttaggcagtgtgtggccctggccagtaataaagactcctaatttgttttttcctggggtggagtggtctctgttcttttaccgcacatttggagaccccagtgagatagagaccctccagcttctggaactcgaacacctccagatcggcgaggggaaaggggtcccttccttaaggggcgtgcgccctgatgatgttccagggcccgaggaaaagggcacccgaactcctctgtgctaatcccaggagaagagcgacttcaccccgaaattagaaaacggagtctcccgggtctggaaatcctctggaggtaggtctggtccgcgatgcggttctggggccagtggaaggcacacttccttgcccagagactggagcgagacgtcgcccagcctcatctggttatctggttcctggttgtctgtgtgactctaagtgtgggttttgtctccgaagtttctgtttgtgttttgtgttctgtgttttctgttaaacgttctctttcctcggaagaataatatttctttttctctctctagccatctccctgcggcggcatctctcgctcccgtgctgtcccctccctgaactctctttaaccatttctttcccttttgctttgacccttcacctactccctcacaaaaggactatctgtgaaccggctactcttgggcgggccctgaaggcatcacttactccctctgcctcaatagctgtccccccgaagggtaagagtccctttttttcttctaacgactggggactaggtcaaataaacactgtgggcgtgggtcaggcacttaaaaaaaagcctttagggcgcctgccacttaaagactccggtgaaaggacaagggggtcaaggaatggaccaggtcgctagggtgtctgcccccccacctaagacaatttccgtgcatcctgtcaggaacatagtggtttgagcaaaacacattgtccgtttctggccacccccccgtttcttcctgcttataattgctctttctccctcttcccctggcctcgggggatgaatgtttttctcatcctgtatgccccattcatattaataatctctattggtctagctgctactgcaccttccgattggactttaggcaaacaggtcctcattgccctgctctacctcgggttaatgaccctattttatgttctcatcatttcctaaaaacctgtcccctggttatagccctttctggactaacgcacaagccattttctcccccttgtttggtgcaggttaagatctggtgtggtggaacaactgttttaaccatgggtttaaagccacccaaaacccctctgacctgcatgatggaccgttttcaagaggccttccgtatccctggggaaggatatggggttcagatgagccgtggaaaactccacactttctgtgagatagattggcccagctccaatgtagggtggccatctgggggttctctagacccccaggtggccctggccatttggaatgtggtgacaggaaaacctggtcgccccaatcaatttccttattgatcaatggttaattctaaccaaaagccctcccctttggttataaaggtgctccctccagttgggaacacgagtgctggtggccaggcccccatgtgaacccctggccccagtcctggcagattccaaccccaaggactctgacccgccaccctatcagtcgggaccatccaggtcacggggcgcaggtcctcaggactatggaggccctccctctagtccgtctcacactagaaccggggccccatatgtgcggcccccggccctctctgctccctctcctgagtcatccttggatgcgaccaccattcttccgctccaagaggttgcatcaggagacacgccaggaattccctttatggtatatgagcccttctccacctctcatctctataactggaaacttcagaatccagttatctgcttgcttgaaactgtctttcacattcaccaacccacttgggaagactgccagcagctgctccagactctgtttaccacagaggagcgggactggatcctggcagaaagccagaaggtgactcaaggaccagatggatgggcaggccgggagcaacaaacgtatagcgcactggttcccctcgcaccctaactgggaccccaactccagagaaggtaaggaggctctggacaactatagccagtttctgctactgggactccgcgctgtggcccggaaacccactaacctctctaaggtaagcgaagtgatcaaggccctcaggaatctccagctgggtttcgggagagcctcctagaggcttatcgtacctgaactcctataaaccctgatgctgctgagaaccagagggccataaacattgctttcatttcccagtcggccccagacattagaagaaagctacaaaagttagagggatttgagggtatgaataagacccaactcatagagatagcacagaaggtatttcataatcgggagctagaggacgaaagaaagctaaagaaggaagtacatatggtggtagctgcattacaggacactaaggagaccagaaaaacctcaaagccccacgctaactcaaaaaggactacacttgaaaaagaccggtgtgcctactgcaaagaaaaaggacgctggaaaaatgaatgtcccaataaagagagaggataaaacaaaaagaaacccatcttggccatagaaagagaggaagattgacggggccggggctccatatctctaagcccccaggaacccatggtatctttaaacataggggcaacaaagtcctattcctggtagatacaggagcagtccattccatgttaacaaaacccttcggaaaaataaaagaaaaacagaccccagtccaaggagccactggaaagtttgaatcctttccttggaccactgagcgaactgtaacctaggaaaaggaacagttacccattggtttttggtcatgccaaattgcccatatcccctcctgggccgagacttagttcataaactaaaagcaactgtatcctttgaaccagaaaaagctaaactgaacttggtatggcccacgaagattttagttacttgccctagtcggaggaatactgtttaaaccaggaacccccctgatattgacaaacaaaaggactcatttacaggaattactatgaaaataccctgaggtatgggccgaatcaaatgcccctggactggcaaagcatcaacccgctatggttgtccaacttatgagccaagccacccctataagggtgagacaatacaatatcagtcaataagcctgactaggaataaaaaaaacgtattgatagggttaatggagactggaattttgatcccctgccagtctccctggaatacgcccttgctcccagttttaaagccaggaaccaaggactaccagccggtccaagactaaagagaagttaacaaacgggttgaaactatccaccccacagtccccaacccgtataccttgcttagcctgatactcctggaatgaaaaatatatactgtattggacttaaaagacgctttcttcagcattctgctggctaagtccagccagcccatttttgcctttgaatggtctgatcctgaaaagggaattaacggacagctcacctggactcggcttcctcaggggttcaaaacctccccgactctgacgaggctctggcctcagacttacagtctttcgggaacacctttccccaggtgacactcttgcagtacgtggaccacctcctgctggcagcggaaaccaaagaagcctgccgagaagctacagaagggctgccaggaattctccaagagctcggataccaagtttcagcacgaaaggcccagctctgcactccctgagccatccacctggggtatgacctagaaggaggtaagcgcaccctatctgcctctcgggtctctgctatcctaaaaattccaactcccacctcaaagaaacaggtgcgagaattcctgggagcagtaggatactgctgcctctggatcctaggttttgtagaattggcaaaacctctctattctgccactgctgggggaaacaccccattaatatggacagagaccgaacaataggccttcgaaaacctaaaaaaagccctaacgtcagctcccacacttgccttgcctgatataaccaagcccttccacctatacatagatgagacaaaaggcatagctaagggagcattagtgcaagctttagggccttggaagcacccagtggcctatctctcaaaaagactggatccagtagcctccaggtggccagcatgcctatgtgtggtagcagcagcagccatcctagttaaggaagctgataaactaaccctgggccaggacttgctcctcacatccccacacactgtggaggccctcctaaaaggaactcctgaacattggttatcaaatgcgcggctcactcaatatcaggccttactgttggaccaaccgtgattaaaattccataaattgatagccctgaacccagccgccctcctaccagacaatgacccactgcagcccatccacaactgcgtggaaatcacaaccggcctacaaggacttcgaccagacctgagcgatattctactggcacaacaaccggaagaggtattctttgcagatgggagcagctttataaaggatggggtcaggttggcaggggctgcggtcatcaataaggagggagaaataatatgggctcggcctttaggccatgggagttcggcccagaaggcggaactgattgccttgactgaggccctgagaaaggcaaaaggaaaaactgttaacatttatactgatagccgatatgcatttgctacagcacatgtgtatgggagcctctacaaggagagaggtctcctgacatcagaagaaaagaacgttaaaaataaaaaagaaatagttggcctcttagaagccatctggctactgacaaaggttgttattatccattgtaagggccaccaaagagggaactctctagaggcaaaagagaaccgggcggctgatgtggcagcaaaggaggtagctaaaaaacgagtggggaagctatggccctgaccacaaaacctcactatacacctgaggaagaaaaaagaaatcatcaatgaggtggaggcttggaccagcaaggatggtggcatttgccagaaggatgcatcagtgtgccccaagccctggggaaaacactgatgcaacagctgtagggcagtacacacctaggcactgggaagatgtctgaccttctctggagacactactacatacctgacttagatgatatgatcacagaccatgtgagcagatgcccagtttgtgcacaggtgaaccgggagggggaccgaaatcctcccttggcgtaaggttcagaggaacatccccaggggaacattgggaggttgacttcacggaggtaagaacaacaattggaggctacaggtacttgttggtttttataggtacttattctggttgggtggaagccttccctaccaaaaaagagactgttcaattaccgtcaagaaactgctctgtgagttggtgcctcgatttggccttcctttatctttggggtctgacaatggcccggccttcacggcccaagtctcaaaattaataagtaaggccctgggtttaaaatggaaacttcattgtgcttatcatccccaaagttcaggacaggtagaaaggataaataggactctgaaagaaacctgactaaactaaggcttgaaactggccatggttggatagaactcctgcctttcatcctgctaaaagtgagaggcaccccctacaaaaggggatccacactgtatgaaatcatgcttgggaaacctccccccttgttaccaaaggtaaaggatcccgagactctggaaatttctaaccataacctatgtaagtctttacaggcccttcaatgagtccagacggaaatccattaactggtttgagaggctacacctaggacagaagggactgatgcccagcacaacttccagccagaagaccttgtgtgggtgaaacaattctcaaccaaggccctggaaccctcttggaagggaccttactccattgtcttcaccacacccactgcagtgaaggccgctgggaaggacccctggatacatcactccaggttgaagctagctcctccagaccaggcagatcagaaatggactgtccaacagtcaaccgaggatccactaaaaataagactggctcaagttacctctgtttaacctttttatttgcctccttcttaacacctgggactgctatatttggggatggggtggttacaacaggcgaggaatgagccccactcaaggaatgagcctcactcaactacccaaaaggaccacagctgaaaaggtcctggaactccggccaccccttcttgagctgtcgaaaaatcaaggtaactggctaacatatatcgccaaggtaacacaaaatacttgacgatagcaagagcccattagctaaaaactgttggatctgtacctcctcttctcctggcttaatgcctattgaagattctggggccaaacattcactaatttaaacttgaccacttcagactactccctaaaaaacttcccatccctaaaaaacttactaaatgttatgttcaaaagggctctattcccttaaaggggctaaaagtacccctcaatgcctcttactgtaatcagactgctactatgcctaaaaatactccctgtaccaccagaggaaaactcttccaatgtggggatgtactgtatcgctgccttccccaaaactgggatggaacatgcattgtagtctgagcaatcccagatgtgtcccgcatccctggaaaacgagcaattcccattccagtatacctaggggctcatctgagaacatgaatcaaaagggagtttcccctcttgattccttgtggcagctctgggcatcatggcaggagtgggcacaggagtggctgggatagtacatagcacaggcctgtctgagcaagtccagggtgacctggatacagtcaagtcaacagtactttctttgcaagttcagttagactcattgacagaagttgtatcacaaaatagaaggggtctagatctcctaacagtggagaaagggggtctttgtcctttcctgggtgaacaatgctctttctacacaaacaaatctggcatagttcgtgatatggtgcaacagttaagagatcagataacaaagaaacaagtcagatatagaaaaaattggttatggggtggactttctggatggctcccctggcttccccctatgttaggcccagtagtcactataggactgattttactttttgcaccttgcctcctctgatgtgttacaggctttatacaagacaggataaaagcttttactcaccagaccatctcacagatggtcctggataaatattagcctgtgcctaacagtgagtcaatgatttgactcaaagaagataaataaaactagtgaggaatgaagggcatttgcctgggccttgttaacatttctcagctcaggacataggcctgggcctcttaacatcccacagcgcccatgcaacataatcaactggcacctaagtctctggcctcagcccccttccttagaagaacaaagttagctgataagggggactgcagatgctacaaggttacccatctaattacctctttggcgctggcagaagatgcctgcttgaaagtcggaaaatatggcccttactataaatcattattgttaacctaaactctattcttagttaaggtttgaagtaatttgactgctgctttgcttttgcgtccctgcttatgcatgtgcacccctccccacctggatgtaagtttgcctttgtaaatgcggtcggtttctttggtgggggcttcacattcaagccgcttttaggcagtgataaagactcctaatttgttttttcctggggtggagtggtctctgttcttttacggcacaacaaagggactattacaaatacattaacattggttggtaaatttgattacagttgggataacttaaaaatacctcatatttttaattcttggaaagtaccaccaggcttatgttagaaggagagcgattccaaaagagagagaaagagactgagagattatttcctgggtcctcattctagctagatgctgcccacacaggcccagcaacagacaagacaggaccagggaacgaagccatcacaggatatgaaggcagagaagcttcggcctgagtttgaggcaaagaagtctcaggagtaactgctgagtaaaagtgagaaggatgagcccatcgttcaaagctctcctcccaccagttggaacaggggccttttgggcttctggagcagaaaaacttctggtttgaggaatatgccatcactctcctccccacccactaaggacgctctaaaaaggcacagttggagcaaacagcctgctggctattgagatttgaatttcaaatgcaggaacttctgaaagaaaaacagtcttcgagcaacataaattgcttccaaacactcagagacacagcagaaagggcaacacaaaccacatgaggccaaaaaattttgataaaccgttataaaatctgttctctttttctgcatcccttcgtccccccaaccaccctgcaaataaccaaaagaagaaggaagattccaagtgccaagaaactctgaggaaggaggtatgttagagaactagctgctttgactgaatcaacagtctccatcaggggaaatacacccctagagagagaggaatttgtgattacttgtgaagccaggcagtcaatggtatgtatttaacttgtaaaggtggaagctgtgttcaactagccagctcctaagcaagtcctaaaggctcaatacagtgcctgcatagcaattagtcactgcccatttggtcatcagcggtctgcggtggattccagacacctcaacggacaaaaccttcactcacacctggacaaagaacccccaggagtatccacactgtgtacatacatcatacacccacaggccaccagggggttaactgttttcatagagaggagaatacgattttgtgagccactgctgaggaactgagtgaaatgagttggagggaagtcttgagaataaatttgaaatgcgcaggcagatctgcagtttttccacgcctgttttctttgcatttaatgtatccctactggtgacccagtcaaagagcaaatgttggattcctgcatttcaggctggagaaatataattctaccagtgggaaataaggttcttgcggtcttattatggaaagcca

SEQ ID NO: 31 - DNA, 3080 bp, Artificial
  ss259 sequence
  misc_feature (2105)..(2105): n is a, c, g, or t
tgtgcttactgcaaagaaaagggacattggaaaaatgaatgccccaaccgtcctgagaaaaagagcaaggccccacctagtcggtaccgatctgagccattcagcaccaacctgatcggcctagctgagtctgattaggggggaccaggctctctccaactgggccccctagagcctatggtcagaattcaagtagggggccaccccatagactttatggttgacacaggtgccgaactttctgtggttacacaacctgtggctcccctctcggggaaagaaaccaccgttgttggggccacgggtaaccaaacccacaggcccttctgtggtcctcgacgatgtcggttaggaggccatgaagtaatgcatgaatttctttacctgcctgactgcccagtccccctgatgggaatagacctgctggctaaaatgggggcacaaatttccttttctactgacgaatcggcccaacttaaattgacagaacccctctctcctttaatcatggctcttgctgtaaaaagggaagaggaatggcgcttgttctctcccccttcagaaatggggaccattcccccagaactagagactaaatacccattggtttgggctgaaggaaacccaccaggactggcaaaacgccacgctcctgtcttaatcgatctaaaacccggagctcaaccggtaaagctacagcaatactcaattcccagagaagctcgactgggaatccaggttcacctggataggctgcttcagcatggactgttaattaaatgtcagtccccttggaacacccctttactgcccgtgaaaaaaccgggaacacaggactaccgcccagtacaggacttgagggccataaatgaagcaacagtcacattacacccgtccgtatcccctgctagggctgatcccctccactgctgaggggtttacttgcctggacttaaaagacgcttttttctgcctccgggtggcacctgccagtcagcccttgtttgcttttgaatgggagaatccacatacagggacaaaggacagctcacctggactagactcccacaagaattcaaaaactctcccactctttttagcggcgccttagctgctgacctggctgaatttcctggacaaaaactgggctgtgttttgctacagtatgttgacgacctcttactagctggcaccacggaggctcagtgcctagagggaacaagagctctcctttccctactgatggaggcagggtatcgggtatcaaagaaaaaggcacaaatctacaaaaaacaagtcaagtatctgggcttcaacatcatgcagggccgacgaatgctggggactgaaagaaagcaggcagtttgtgccattcctgtccctaccacccgccggaaggttcgtgagttcctaggggcagcaggattctgccggatatggatccccgggttttcagacctggccaggcctctgtatgaggctctaaaagggaaaaaagaggctccccttaaatggggaccaagccaggaaacagcgtttcagacaatcaaaactaaactcactgaggctccagccttgggacttcctgatgtaaccagagaatttaacctgtttgttcatgagaaaaatgggatggctttggcagtcttaactcaagaatttgggccttggcagaggccagtggcatatctgtctaaacaaattgactcagttgctgccggatggcctccctgcctccgagcgctggcagctaccaccttgttggtaagagaggctgacaagttgaccctgggacaaaacctcaatgttaaagtcccacactcagttgtaaccctaatggataccaggggccaccattggctcacacatgcacgaatgactcaatatcaagggttactatgtgaaaatccacgggtaaaactggaggttgtacgaactctgaacccagccacttttctgccagatgaagcggggcccccagaccataactgcctggaggtactagatgaggtattttccagcaggcctgacttgactgataaaccactccaaaatcctgacctggttttatatactgatggcagcagctttatggaggatggaanaaggatggcaggatatgctgtggtatctgacttaaaagtgataaaagcagaggtgcttcctcaaggctggtcagcacagagagcagaattatgggccttaatcagagcactggaactcagccaagaccagcgagttaatacctataccgactcacgatatgcctttgccactttacatgttcatggagccttatataaagaaagagggctcctcactgctgaaggaaaaggaattaaaaaccaggctgaaatcttaaagctcctagtggcagtatgggaacctaaagaagttgcagttacccactgtaaaggccaccaaaagggggatgacccagtggcaaaaggaaaccgtagtgctatgcagctgccagacaggcagcccggggacaacagccagacaaacctaaggtcttgctggccccagaagtgccagctgtccccaaatattctccagaggaagaaaaatggataagggaggaaggaggaactaaaactaaaatggggtggtgggtcacacgggaccaccgagtttacattccagaacagctggcctacaaactagtccgccaagaacatgcgctaacccacatgggcaaaactgccttagagaccctactgggccggtactatctcattgctcgtcttcctgcactctgctcctctgtctcccaaagatgcataacctgtttacagaataatgcccgccaggggccccacagaccagctggggcacagcactgcggactgtccccatttgaggatatggaaatggactttactgaggtcactcctagtaaggggtacaaatatgtactagtttttatctgtacattttcaggatgggtagaggccttccctaccggaactgaaaaggcaagaaaagtaaccaagacactcctgagagacattattcccagatatggaatgcctctgaccatcgggtcagataatggaccagcatttgtggccgaaata

SEQ ID NO: 32 - DNA, 10330 bp, Artificial
  ss268 sequence
tggcctgggagtctggggttaagagatgcaaactattgccttggagtggataagcaatgagatactgttgtatagtacagggaactctatctagtcacttatgatggaaaatgatggagtataatgtgagtagaagaatgtatatttatatgtgtgactgggtcactttgctgcacagtagaaattgatagaacagtgtaaacctctatatcagaaaaataaaaaccatcaaatccaaaaaataaaaatataataataataatttgttactgctgaggaatacaaggatcagttcaagcttaaatcttaagagcgatgaaagagaagggtattattttggagatatacattattttgaaattacttttgtatgccttatccaagtttttgttcagatttaaactggctcattatcatatcctaaacaaaaaaggttaatttgttttttgtttttttttttgtcttttgtcttttcaaggccacatctgtggcatatggaagttcccaggcaaggtgtccaattggagctgttgttgctggcctacgccagacccacagcaatgccagatccaagccacgtctgcaacctataccacagctcaaggcaatgctggatccttaacccactgagcgaggccaaagattgaaccctcaacctcatggttcctagtcagattcatttccactgttctatgatgggaactccaggttagtttttttttaacaatcaagataattcttattcctattccatcacatttcatatttttccttcttttgatatttacggagttgtacatgatatttctttctcctattgcataagttacagtggcaaagtaactgatataagttcaaatagatattacatatatttcaattaatcaaatttattcctataaaatatggaatagtatatgacaatgcaaatgtgtcaaggaccataaatatccagctgaataatttgattcctaaaaatttacttttaacatttctaaaatattataattatacaatgtaattaagatacagatttcattttaatttcatataaagtttttttgtcttttttttagggccacacttgcagcatatgaaggttcccaggctaggggtccagtcggagctgtagccaccatcctacgccagaacaacagcaagtcggaatcggagctgtgtctgtgatcaacaccacagttaggagcaacaccagatccttaactgactaaacgaggccagggatcgaacctgcatcctcaaggatgctagacttgttcattaacagctgaatcactagggaaactcccacttataaaatattcataaaatgctattatgaatatcctgtaactattttaagctaattttagatttatttttcaatgaaagcattcttaattgacttgaaacatactcaaacggaaaaatatttttgataaaaaagacacgcgaaaattgccaaaagtcagtttaacgtgaacacactttcctttaatgattaaagcttttgagggggagaggacagagatcaccagtattaaccaacatataattaaaatgtaaaaattaataataattattacattaacatgcatattttaaatctataatgatgacagaataaattatacaaaatattggttgattttaagctttttaaattattgtattttgtagtaatataatattgataaattttaaaaattgacaacagtgtgtattgccaaggatgtgaaaatggaaatatcatacattgttggtatgtaaattttaaggaattatttaccaggtttgtataatattaactgtgtacttataatataatttagcaattccctcctgtccttcctccctttctttctcctctttctccctactactctttctgaaaccctctgtgaatgggtgagtagctatagaagcaactgacaaattctggtcagggatacaccttgatgtattctgcaggccccatagcccactgccttagtaactgttgcttaaaatgggtgaatattcctcctttcttctcttcggctggggtctaggtcaaatagtgtcacttgggcatgggacaaggaacctaaacatgatcatcacccttgtcattttgaagactcccgtgaaaggataaggcggtcacagaacagcccaggctattagagtgtctgtccccattaagacaatttctgtgcaacataaggcatacatttgtttaagcaaagcacacaaccagctgccctgaccgctgcctccccggtaggattgtaagacagagtccccagccttccctttcttttatagtcactttgcttcagaccttgaagaaaccacggctcctgagctgttttaaaggaacctcactgcttttcttctttgtctaaagaaactatctctggaagatcccattgtggtgcagtggttaacgaatccaactaggaaccatgaggttgtgggttcggtccctggccttgctcaatgagttaaggatctggtgttgctgtgagctgtggtgtaggttgcagacgcagcttggatcccgagttgctgtggctgtggtgtaggatggcagctacagctccgatttgactcctagcctgggaacctccatatgccacggcaacggccctagaaaaggcagaaagacaaaaaacaaacaaacaaacaaaaatactatctctgaacaaaacctcagtacacttactcaaacctctggatatcccagggcaatttcttcctcctccacctatggcacaagccatgctccctctgtcaagggaaaggacattgggccagggatagatccatagccattaaggcctactcccagagggatgacaccacctaggctaaacaacctagcctaagataaagatacctacccatcttctcaagtgtggtatggataactcagaccagtgtgaaaccttcccatggggagccaactgcactaactggctagaggatgcactcctttgaattttgaggggtattaggagtgccctcaaactacacaagttttgacctggggacacccaactcgcaagcctgccagaacagtccccaaatccttttgttaccttgcaaaaagtctcacctgtcgagactgggaatgctcagtccttcacaggagtgtttgggggtgcacgcgaatgccccagaaccaggcctttctctgacctatggatacccagctcccagagactatccattagccaccagagactatttgttagcttctttaacccatccctgtctcttgctacgactgttgtttcagatgggaaacaagcagtcagccctgctgaggatacctctaagatgtatccttaataattgagatctatttgacccccaaactcagaagaggaggagaatgaactttttctgtaacaccacctggcaccaatacctactcaggaatgggaacactggccagagaatgggaacataaattttaacactatcctacagctagacatattttcaaatggcaggggaaatgggggaggggatagcctatgtgcaggcaggcttccagctgagggaccacagggagctatgtcataagtatggattagacactgattgatggtatgagcccaacagacaccaatcaaggaagggggcaccccatatcagggaaatttaagaaccgaagtccctcatgaggtaaccataaagttcccctaaatctatccagaataacttccttattcaggaccaagcctacagttaggaacaatgggaacatgctcacaggttaaaaaaaaatggagaaaatgatacaatacccaatgtaaacatctgcccattagtaaagataggaaaagaattggggtcttgtgtggtacacaaacccttctcttttcttgaatgaaaacaaatcaaacaggactgaggagctatacagaccacccaagccatgatatagctgctttccaatatgtgacattagcttttgacttgacctgggaggatgtaatggtaatatttagccagactctaagaggcctggaacaaagctgagtaatcagggaagctaggaagtatgccaccgggcttcacatgtctaattctaggtaccttgtgtgggaaacagacccacctcagaccctaattggaactataacaacacaggccaggaattcccatcgtggtgcagtggttaatgaatccaactaggaaccatgaggttgcgggttctatccttgcccttgctcagtgggttggggatctggcattgtcataagctgtggtgtaggttgcagatgtggctcggatcccgcgttgctgtggctctggcgtaagccagtggctacagctcctatttgacccctagcctgggaacctccatatgccacgggagtggccctggaaaaagaccgaaaaaaaagacaaaaaaaaaaaaaaaaaaaccatacttgggaaagataccattttctctcacgtatcaaagaaggactgaagacagcacagcaaaaggtaatcagttacatgaaggtacttgcagggacccagggacatgagtaaaactctgctgccttcctggagaggctacaggatgcactccagaaactcacattagaccttgagtcctgtgaagggcaggtcatcttaaaggataagttcctgacccaatgaacatcggacatcagacactgggtaaagttatagaaactaaaatagcaggaccatggtcacactagatgagatgatccaagttgtcactaacacctattacaacagagaataggaaagggaggcgaagcctcaggagaaggataggagcactgggaactatgtctggtcacttgtgatggagtgtgataatgtgagaaaaaagaatgtatacatgtatgtgtgactgggtcacttttctatgcagaagaaaattgacagaacactctcagtaagctataatggaaaatataaaaataattattgaaaaaaagaatcttaggcatgcccaaattattacagccctccaaggacccacccaaacctccactaatgcccctaaaaacaaaccagatgggaaatgccagattcgtagacagtcaggacattgggccaaagagtgtcctaaatggaactgacaaccaaaaacagcttgcactaagtgtcattgacactaacactgggaagccttcttctcccaagacccctgggcccctgggttagaagcaaacccaaaggcaaatatggtcccacaggacagaaattgacctacctcagctggccccactttcttggatcatcatcccagggctggaaccaagggtgcaactggatatggcaggtaggactgaaacttttcttgtagatactggggctgtctgctctgttttaatcttctcatacccatctcttctcaaacctgtaccattctgaaagccacaggaaaaccaacactaactgctttacactgatactactttgctggtgggatggactgacattcacccacagctgcctggtagtccctgaatcccccattcccttactggaaagggacatactctccaaggtgggagccaccacaaccctagatggcactcctggcccaagacttgtgcaaatccttgtcatttctggaggtgaaaatacacctgagcctctggagacataatcttgggaactggatattgatcccctggtcagggaccagaaatacctggacgagctcacagggcatcctcattagtaatctcacataaggaccccaccatatttcccaaccaaagacaatatcctcttaaaagagtggctaaagaagtactacaacccacaattaacaagttcattgcctgcgggttgttgaaacccaccagttcctagtgtaagactccaattttccctgtgaagaaaaatgatgggatttgaattgtccatgacctaagcatagttaatgaatcagtggttcccttgcattcgaacatatctaacccttatatgctactcggagagattcctctggggtctcaattattcatggttctcaacctaaaggatgactttttctgtattccactggcaaagtatcccaattcctcttctcctgtgaatgggatgcccctgaaggaaaccactagtagctatcatggaaagtcctgccacagggattcagagacagctccatctttttggacaggccttagcacaggacctagcagacctagacttagaactaggaggaaagctgttacaatatgtagaggatcttctcatttgttcactgagtcaaaaagaatctcaagaacacattatactggctcccaactttctggccataagtgggtaccatgtctctaaagcaaaacccagttcgtgaaacaggaggtcattactcaggagtaatccttactctgggaactcaatggctgtcatccgatcgagtgaagggcatattacagctacccaatcccatgacctgaaaacagctacagcccttcttgggccttactgggtattgtaggctgtggacacccaattatgggctcattgcccagcctctatacaggtgacttaacaggtgggaccccttctgtcatggggtccccttcaagaggaagctgcctccccctgaaacaggccctgatccaggccccagagccaaagctaccacaccctcaccatgggttccaactgtatgtatagagataaggtgaatggtcttgggagttttgacccagagggttggaccagaatcaaggctggtgggatacctctccaagaggcttcatcccactgcacaggtatggccatcctgcctataggttgtagtggccattgccttcctgattgaagactgtctcaaactcacccttgggggttctctaaacatgtatacccaccaccaagtgaaagccttctgaatagcataggacacatatggatgtccaaccagaggatcatcaagtaacaggtgatgttacacaggagaccaccctcacctggagggaagccctacctatctctttcctccgaacctggatgcccccaaggaataggtaagtctaagcccctttgaggtcctatatgggagactctttactttagccactgaggcactcttagatccataaacacctgccctacaggtatatgccatctcaggggcaaaattccaaaatgaggctaaaaatctggaggtaccaagggggggagaggatgcctatttaccacccctataccctctaggatctcaggtcctaattaaacactggaaagatggatccccagcttcccaaatatgacacacttggaacgggccatatccaataattctgtccacccccacagtggtcaaagttcctggactggaaacactgatacagcactcctgagttaagctatgctaagctccagtagaggtcaaaacaacatcccctgtgggccacttggagacctccgatacctcttcaaagcatcagacaaggaaacttgtccctcacaataggcctctttctcttaacaataatcccaggcctactcactgattccatcatgaggaaagaccagtttcctagctaggcatacaccgttgtaaaccacaccactacccaactaacatcactgccccttgctggatctgcatgaacacctgtagttgggggtatatctagcccatccatggatacccctgggtcactatttccagctcaggtagaggccaagacccaagaaacttcccccagaagagggatggcattttggataaagggagaataacactttctctcctggtaccaacaacaattggcaacattaaaatccaaagccagcacccttcctgcatagcccatgttgggttaagctgaccagcttaacccaaataatcttcacaatttgtgttgagaacagtggacccagaaaacacatagggagtatacaaagatctaggtgtgggttaataatagtaacactcaacagtccttagcttgtgtttggtactatgccctttacaaatatgaacaaatttcttcttctaatattcctaggtataaaatattttattattagtagtagtattatcacagatgttgagtgacctgctcaatgtcacctggttagtaagtgatggatctagacttccaaccccattctgatggcctccaggattcacagtcatcttgatccctataccttatctattgtgtggcagaaggaaagaagtggatgtaataagagaatttcaaaataatttttcttctttctttgccacatccatggcgtgtggaagttcctggaccaggaatgaaacccagagccactgcagtgacaacaccagatccttaacttgctgagccacaagaaaattcctttgctaagtgaatttgatttggcatttacttgataagagttacagaataacagaataaattttactaaactctgcttttattgttatatacatttaacctcatgcttttatttttttttctgctgtacatcatagggaccaagttacacatacatatatacataatttttcctcccattgttgtgttgcaatgtaagtatctagacatagttctcaatgctgcatagcaggacctcattgtaaatccataccaagagcaatagttcgcatccattaaccccaagctcctgatccctcctactccctccctatccccctgagcagccacaagtctattctccatgtctatgattttcttttctgtggaaatgttcatttgtgctgtatattatattccagttataagtgatatcatatggtatttgcctttctctttctgacttatttcactaaatatgagagtatctagttccatccatgttgctgcaaatggcattatgtcattcttttttatggctgagtaatattccattgcgtatatataccacatcttcctaatccaatcatctctcagtggatatttaacttgtttccatgtcttggctattgtgaatggtgctgcaatgaacatgcaggtgcatgtgtcttttttaagttaagttttgtctggatatatgcccgagagtgggattgctgggtcattaaaaaaaacctcatgcttttaaaactataattaggtaggtctgatacagagcaggagtcattactgatttaaattctaaagttctaaatatataccttctgttttgactactctcacatttttacaatttctatggacatttcattattgggttcacttttcctagctccatgctgtccattcctgctttttgggatcccttgttgttgaccatggctaagaaattttttacttttttagcattggtgtagatatttatttatttatttatttgtgtttaagatttcagaagcagtccactagtttatatgcatccagagggaaagtgctattatatagtttagaaccacttagtataatgtctagtacataataaatcctcaataaatgatgtgatttcaatctataaataaaacaaatatattaatgttatatggtttgctcagcttagattcaatattttaattgcagtaattggctggtaccaactaggtgattactggtcatcccagaaatcaatgaacaatttccttaaaaaaaacatttgtttcctatcacaactatctgccaattttttgctatttcacatatcatgaaaaaatttccaagaatttacccatactgggttgatgaattaattaactagaaaaactgtggataaggttcaactttaggtatatttcctaagtttttgttaaagaaaaacaagtttattgagatatgcttgattataagaaactataaatatttaaactatacagtttggtaaatttgcctactctatgaatagaacccacaataaagatttttaactattcttagaaatgttaagggatgcctatctcaattctctattccattagacagcattgttaaatattctacagtttggccatgtgcatttacttccactcttccttgtctgttctgaagtcatttcctacctgtgacaaatatatctgtgtatatatgagtgtgtgtgtaaatggtaaaagggaagtaaaactaaatatcatagacatatatatcatacttcagaagtttggcaaagtctaatttttcctttagaaaattattatcaaattttaaactaatggtatacgtttgtttttgatttatattaattaattttatttttttaatctgcatacctgctataaatagaacctataatactgataattctttaatccattttaaaacataatgtttgtcaataaaaataaaaataaacaaatgggacctaatcaatcttaaacgtttctgcacagcaaaggaaaccctaaaaaaaatgaaaaggc

SEQ ID NO: 33 - DNA, 5653 bp, Artificial
  ss274 sequence
tcagggagtcatccagatactgaggaaaacccttaggctttcctggaatgcctgagggagtgccttcatatattcatgaacatgaacccggagtcagtggaagggcgggccactcttaggtcccatttcacttcccagagtgcctccagacattacagaaagttggagaagctggaaaattagggaagttggagatagggcccaccttgcccacttcctggggtagagtcagcatttccagtgttcagtagccaatctagaggcagatgccaaggaagatagatgagtagaacaaacttccagtattctgggctcagcagattcagagtcaaccaacctccctgtgatgatggagccctccagaagggaccctgtgacactgatgagtcaccccaggtcatgcccacagtggggagagggctcaaagccaatcagtgtgcacactgcatggaagagggccactggaaagggtaatgcctcagacatcctggaaggataccaccatgtcctaggctatcctcactggtcacatatatcaaagaaaaagaggactaaaggagctcaggagctcctgcaggagccttagctgactcttactgggggtggcaggtaaaaggactggcttcctagtcgatacaggagccacctactcactcttgaacacctgccaaggcagaatgagcaaagctaaaggtaagataatggaagtggaagggaagccacaggaatttaattttacagagccccttgtgtgtgatgtggaagggagaatcttatttcactcttatatgcccaattcctctaatagaaaaagacttagtatacaaattgggagctacaatttatctcagagacaaaaaccttatcatcaaaatacctaagactcccttccattctgtagccctagtgcaaatgccctctgtcaagaataagggcccgattaatcttgaggaggttaatccctcagtacaagcccagaacaccatgggcagagccaggagggcaccactggttatagtcaagctgtgattctgacacagtcacccacataaacaacaataataccctttaagcaaagaagccctagcagggacatagcctactcaagcaagggtttcttagaacctgccatccccttgcaaccctcctattctgccaggaaaggagacaaatgggaaataccagctagttcaggacctcagggccataaaagaagctacagaggagagtccccctgtagtaccaaactcaaacacattaccctctaccctatacctaagagaatctggtattcagtgttatatgtaaaagacaccttcttttgcgtgcccccaaccctagaatctcaatacatttttgcatttgagtggcaggaacccaacaacttgaaaaaatagcaattattgtgttggatggttttgccccagggagttaaaaactcccatgcccttttgggaaaagttttagctgagaacctcagtgacctcaagttagaacagggaactattctccatcaagtatatgacatcttaattgccagccccagcaaagagctttctgaccatgataaagttaatgtcttaaatcacctggctgagaaaggatatagtttcaaaggaaaaaccccaaatctccctcaagtgggtagaatttaaggttcattatagaaaaggggcacagggcactaaggagtagaaagaattggtttgccaaatatcacccccttgtacaagaaagtagtttcagagttttcctgggtactgctgcatatggatccccaactttggcttaattgctaagccctttatgaacaattaaaagggaaggacattgaccctttctagtgaacccccaactgtgaccaagtttcctcaaactgaaaaatccatctcatgaaagctcccactttaaatttacccaacatgtccccttcatctatatgtacatgacaaaggaggaacccccttggggtacttacacaaaaaccaggacctctgactcacattgtagcctatttttaaaaacaactggaccaaactgctgaagctctgcctctatctgctatgcctataagggtaagttaaccaccctaatcggaacactagaacttgggaaagggaaagttgtcagttatctacactaattctaattttttttattttattttttattttttattttttggctttttgctatttcttgggccactcccgcggcatatggaggttccaaggctaggagtctaatcggagctgtagccgccagcctacaccagagccacagcaacgcggaatccgagccgcgtctgcaacctacaccacagctcatggcaacgccggatccttaacccactgagcaaggacagggaccgaacccgcaactcatggttcctagtcggattcattaaccactgcgccacgacgggaactcctacactaattctaaatacacctgttcaatcctacatgcctatggttgtcacctagagggggtgaggaatgccgatgtcagggaataaacagattatgaatggggggggtggattatgcagatgctggaggctatatgcctgccaaagcaggtagcatttattcactgcagagcccatcaaaaaggagaagcagaaattttaagaggaaataatagagcagacatggcagctaaaccagcagcagaggatgaggacaggcttcaaatgccactcctactggctcccccagaccctaactcaaacactacatatataccccagaagaaagggaaaaggctttgagatggggctattttaacagcccagaatacccagggcagatggttaacggtcatgggcagctattcctcctcccatcagccattgcactgcaccacctgggaagctcaccagaacacacattatgggcaggaggccctatatcaatggcccatcaaatccaggactattcccaattccacggtctctttaaacaggtggttgaaacttgccccgtctgcctcaggtacgagcccaacactcacccccaaggtcaagggagtatgacctccatacagtatcgagcacatacccaggtcaagagtggcaaactgattttacagcagcaaactgcttttacagtaacaccccaggcacaaggaaattttagatatatgctggttttgactgacacctttgccagctgatggaggcattctatacgtgaaccaagatggccttggaggtgtctaaggtcctgctcaaggaaataagcccttggtttggtctccctaagtccatccagagtgccaacaggcctccctttgtttcccaaattactaagggagtctctatagccctatgaatgaaatggagtttacattccaattagagaccacaattctcaggaaaagtagaacaaatcaaaccctcaaaagaaacttagccaaactatgtcaagaccctcatcaaccctgggtctcccttctccccacagcactttcgagaatctgaacagcccataaaggaaagttcaggttatgtccacatgagctcatggacaggaggcccattcctgaaggactggctacaaagccaacatcagggatatggaccaactgcaatacgccttacagagagcagaaacgacccaagccttacacgcctataggaatctagcactgctttctccttcagccttggttttacatcctctctccactgcggattgggttgatttgaaatgaaaagctggaaatccacaagaccagttagagcccaaggggacagaaccttacctagtcatcttgactactcatcctaccttacaagtacagggcataactcggtgggcccccatactagagtgaagacagcacctacgcctgaggaagaattaactgaaccagtcactcaatacacctgtgaacctgtcacagaccttaagttacttttaaagggatgaactcaccaatagataagtaatgtgggggagaggcttagttgttggccttgtcactgctattgccttacttggtttctgctcttctgccaaaccctctgtccatgcaggatacagggtatattaatattggaagcaggatgagtggccattactgcctattctttcttatcatctctgctctaactgtccacatggaataggaattcagtgcaatagtaaatttcttgaggattatagcccatggacaaaatctttcctggtgctggatccatcaaagtgacatctatggattaaacatattacattttacctgtaagaacaacttcactctcaacttggttaaatgttctgctaaaccttcccctcttgaagtttatatcccatccctaatgcagctttctgcttagatctcacccctcttattaacatttttaatgaacacaaagcactcactctaaagtgccatcatggtgtggctgccactgcccctatcaaatgcccctcccaaagggaggaactttcaagggattcactcctacagaaatcggccaacggtgcactgactcagtgaacacacagggggaccagatgggagatgtacttactgggaaagaagacactggttgtgtagtgtttagtatgtggccctcctgaggcctggggaaaagctcctagtcaagaaccgccccccagtgacccctgctatgcaggtagacctctctccccacattgcaaggacatgcttcttggactagccacttacagaggtaggtcaacccctcagaagtgtgccaggcacaagctccccctgggtacctgttcctttgtggcctgagaataaaccaggtgtcccatcagaacaaccctaattaattcccttctccagagggggtactttggcctatccttgcttagataatgccgaatttgtccacaatgcatgctaggctggctaagttctaggaacctaggtataattcttcatactatcaccagctgcaagataaaagggcaatagggctcatcttggcaggagtagggattgttctgggactggagaccctctgaggaagttttgcatatcatgaaatcactctacagaatcttacatgggcccttgaggatttgtctaaaagtgccttatgaggactccagacttcttactagaaaatgttctcaacaacaggctaggctttgactatctcctggctgagcaagggggagtatgtgcagttattaataaaactgctgcatgtatgtcactaactctgatccgactgaaataaacataaaagagatatatatgcaagctcaatggttacacagatgtaacacacaaggtccagatccaagctccatctagaatatggtcaaacagaacctccccagtttaacttggtttcttccatttcttggcccactaactggtattattcctgctcatctttgggccttgcctcattaacttctttgtcaacttcattagtaaatgccttgaaggcatcaaacttcagatgacactaacacaaggatttcagcaagtgggactgcagcctgaccacaatcagaattatcttaggctagtcagggaacagttctgctcctccaatccagtggaaaactacacctatgttcagcaggaagcagcctcaagacagaccttcacctttcagcactagcagaactgaggagcaggaacaaggaaggggtggggggtg

SEQ ID NO: 34 - DNA, 8224 bp, Artificial
  mm631 sequence
tggaaaaagcatctccagggcagtcttcaacgcagcctgggaggtgcctggctttgcctatgtttactgatctccttctgccatcttgtggccatgagctggatgtacatgcaaattccgatcatctctggggctctgacttatcagtttgtcccctgcaacccacactctggaagggagaatccactggacccataatttatttgctccttagaatgaaacaagggaaaagaaactgattgtctgagagcgtggttaagtaaccaaaacagaagcagaaaaccagatgccaacttgttgcaagctgaactttggctaaaattgggtaggtgcggtgccctcgtgtcaactcaattttgttctgatgtgcaaaactaactatgcactgcagcccacccatcagtgatattccagaacatttatgtatgatgcctctgctgcattgttccgctaaatttactaatctctaattgttttaattgagatttgtcatattttgagtaacatcgaatactaacaaaataaaaggaatttcttgtttcctataataacaacaaaaaaaaagtatgggaatcttcaggcatggattgatccagacgttcacattgtcttagggttccaggtccatgtctctgtgattctttctcctctgactgcctctgaatgttggtgttatccctgggctgctgtgccctagagcagttccaggcctggcctcgtatctgcgggttacattgtccagagaaagacaggatatctcttcaagtagtgcccagagattgaggaagcatcctggtcagaagcccttggtaaatatttcccgatctctgtgaggaccaggctggatcccctgctcacccctaagccaatcataaggcccaagggagatgggattctctgactggcataaaccaaccaggggccaatcctggagctggggtgggatcagtctcatgcagcactcctagctgccacagagtgaggtggcaaagaaaaatgggaccaaagaaaacaggaccctgaattttgatcaaagaccacgcaagtgaccacatcattgtgtggtctccaaaggtttttcattatatatctcaatcagtaaacacgatgagtatttttctactactaatgtagcaatatatgtgtacactataaaaccaatttttttttcttttttgccactttcttgggccacttctgccgcatatggaggttcccaggctaggggtctaatcggagccgcagccactggcctacaccagagccacagcaacgcaggatctgagccgcgtctggttcctagtcagatttgttaaccactgcgccacgacgggaactccccaaaatattttttatttaattaaatttgtttatggctgcacctgcagcatatggaagttcccgggccagggactgaatccaagccacagctgtgacttactgcagcaaagatggatcctttaacccactgcactaggacagggattgaacccaagcctccacagcaacctgagctgctgcagtccgattcttaagtcactgcaccacagtgggaattccacaaaaatatattttaaaggctgaaatgatagacaaattataaaaaagttttatgttattttgtttagtaacaaagttgaaaaatctttttttgctgtcgagattgtgattggaaatgctttattctctttttaaaatcttagcttaatcttttattttatttatttatttattgcttttaaggtcacacccgtagcatatggaagttcccaggctaggggtcgaatcagagctgcagctgttggcctacactacagccacagcaacgctggatctcagccgagtctgtgacctacaccacagctcatggcaacgtcagatccttaacccaccgagcaaggccagggttcgaacccacatcctcatggatcctagttgggtttgttaactgctgaaccacaaaaggaactcattagcttaatctttatgactcaaaggcctagtgttaagttaatgtctacacttagttttaatggctgttacagcagaacaagatactgatatgtagattcaaattgggaaaattatattaacaactgcactgcctaattcctgatactagtttttctgttctatccacaatttatacaaagtttttttccatctccttgacaccaaaaagtattttatttttcgaatcaaatgaacccttaatagggaagatcataaaattctgtttttcaagtgtgcaaatgttggaatttctataaatgacatcatttggggccacaaatcacatcttaatgcaatattcccaggcatgttcaaagtgatctctttatagcagcagttagagctgttgtaaggctgcatcattctttcaaagtactgatgttaaaaatactcattagtagcatgctactaaactgcatatcacaggaaagatcggcaaatttagaacagttaaagcttttcttttgtttgtttgttgaagaaaaatgcctaattcatctccaagtccaaaaattcttttaagcactttaccacgatcaatccaaaaactatgtggtgcaagagattttcatggccacgcctgtcttccaacttcatttgcaaaatactgtaaatatcctcttattgaaaggtcttgtctttagaaagtagccatgtcaatgacaacctgtaacaacctgtaactaacaaaagggattcattgctagtgaatggaggagtgagggcgccatcatcaggcctcagcattgtggccgccacctggtcctgaggaccagccacgtgactccggctgtctgccactggacctagagaggtgctcagggaaagccagatggctaaaatgagtaaaataatgtttatttctaagttttagtttagttctaaattttaaataaacaacacaaaaaaaatagaatttcttatgctttcttcctgcatcccagggcttctcatgtgctcctctggtgtgcatgctcccacgtttggagaccactgccccctggtagttctttcaggatgctagccttgcctgccccgccctaccatttctaagctttttaggaacaggggctgagcctggtccttcccatccctcccaagaacccagcacaggggagagcaaagctcagcagttccatgacaccggattaagggatactgaattttgttggccaggagccctggaatgtgcagatgcctgtgcagacccagctgcagtagggctcagagatgaataaagcccagaccctattcttgagcctgccacacgtactggggtgtggcgggtgtaaatatgggatggcatacaccccaggcgagaatgaagtaggagctgctggagatatgcaagaaagggtatgggagaatgaaataaaagacttttggctcgcgttcattctccctagagggttgaagaaaggcttcctagagaggtagcattctgttcagtggtatagatttttgtaccactgaaacaaggggaacagatagagagaagaggatgaagtgccctttaggagatgtcatcaaggaggagggcttgttgggagaaagcatagatgaacatatcactcacaaggacgaactaaaagattccacaggtagtgggctaggacattgtagtagcattccgtcagaattccagatatactggggttttaataaaaaggtttacatccattcatgatgaaaattctcaccaaactgaacattgagggaaaatatttcaacacggagttcccgtcgtggcgcagcggttaacgaatccgactaggaaccatgaggttgcgggttcggtccctgcccttgctcagtgggttaatgatccggtgttgccgtgagctgtggtgtaggttgcagacgcggctcggatcccgcgttgctgtggctctggcgtaggctggtggctacagctccgatttgacccctagcctgggaacctccatatgccgcaggagcggccccagaaatagcaacaacaacaacaacaacaaaagacaaaaagacagaaaaaaaaaaatttcaacacaataaaagctatttatgacaaacccatagccaacacaatactcaacagtaaaaagctgaaagccttctcactaaaatctggaacaaaacaaggatgcctggtcccaccacttctattcaaacatagtattggaagtcctagccacagccatcagacaagaaaaaagaaataaaagatatccacattggaagggaagaggttaaattgtaattatatgcacatgacatgataccatatatagaaaaccataaggattccacataaaacctattagaactaatcaacaaattcagcaaggtagtgggatacaagattaacatagagaagtctcgtacatttctttatactaacagtgaaatatcagaaagagaaaataaaaatcaatccttttaaaaagtatgtctcccaaaaaaataatattcctgggaataaatctgaccaaggacgtgaaagacttatatgctgagagctataaaacactgataaaggaaactgaatatgattcaaagaaatggaaagatgcaaactatgtctagtcacttatgatagtgtatgataatgtgagaaaatagaatgtatatatgtatgtgtaactgtgtcatcatactgtacactagaaaaaaaatgtattgggataataatttaaaaaaggaaagaaagaaatggaaagatatcccatgctcctaggttgaaagaattaatgttaagtagccatattacctaaagcaatctatagatttaatctgatctctataaaattatccatgacatttttcacacaattagagcaaatggtactaaaatttatgtggaaccataaaagacttagaattgccgtggagttcctgttgtggcacagtggaaactaatctgactaatacccatgaggatgcaggttccatccctggcctcactaggtgggttggggatccggcattgctatgagctgtggtgtaggttgcagacatggctcagatctcagtgttgctgtggcagtggctatggcgtaggccagcagctgctgtaactccaattcgacccctcgcctgggaacttcctatgctgcaggtgcagccctaaaaagcaagataataataataatataaaaaataatttaaaaaagatctagaattgccaaagaaatgctgaggaaaaagtacaaagctggaggcatgactctccagacttcagacaatactacaaagctacaataatcaaaatagtgttgcatcaacacaaaaatagactatggctcaatggaagagaatagagacaccagaaacaaacatacacatctacagtcaactcatctttgacaaaggatgccaaaatatacaacagagaaaagtctcttcagcaagaggtgttgggaaagctggacagccacatgtaaatcaatgaagttagaacacaccctgacaccatatacacacaaaactctcaaagtagcttaaagacacaagaataagacctgacaccataaaactcctagaagagaacataggcaaaatattctctgacatgaatcacagcaatactttcttagttcagtctcccaaggcaaaagaaaaaaagtaaaaataagcaaatggaacttaatcaaacttacaagcttttgcatggcaaaagaaactatcaacaaggcaaaaagacagcttacagactgggagaaaatatttgcaaatgatgcaactgataagggcttaatttccaaaatatacaaatagctcatacaactcaatatcaaaaacccctaaacaacccaatcaaaaaatgggcagaaaatcttaagagacatctctccaagacatacaggtggccaacaagcctgtgaaaagatgttcaacatcactaattattggagaaatgtaaatcaaaactacagtgaggtaccagtcagaatggccatcatcaaaagtctacaaacaataaatgcagagagggtgtggagaaaagggaacccttctatactgttagtaggaatgtaaactggtgcagccactatggaaaagagtatggaggtccctttaaaaattaaaaatagttaccatacaatctagtaatcctacttctgggtatatatccggaaaagatgaaaacactaatttaaaaagatataggcaccccaatgttcatagcaactctgtttacaataaccaagacatgggagcaacttaaatgcccattggcagacaattggtctacagacacaactgaatattactcagccataaaaagaatgaaatattgccatttgcagcaatatccatagatggacctagagattatcatactaagtggagtaaaccagataaagacaaatatcacatgacattacctgtatgtggaatctaaaaaaaaaaatgttgcaaatgaacttatttacaaaacagaaatagactcagacatagaaaacaaacttatggttaccaaaggggaaggggcaagggagagatacagacaaatttgggattaacagatacaccctactgtatataaaatacataaaccacaaggacagactgaatagctcaagaaactgtgttcaatatcttggaataacctttaatggaaaagaatctggaaaataatgtataataatgtttccagttatatgttcagtcatatgtttatgtatcactgaaacactttgctgtacacctgaaactaacacagcattgtaaattaactctattttactttttaaaaacccacttttttttttttttgcctaatgggtaaaaaggtcattatatgtggcttcatagataattattcctattcctcctacaccactaatatgatcctcccttattatggtttttgggagtagcttccctctgcctgtaatgccctccccagagggtaacacggctggtccccatgttattcagtgacttcctcactgagaggagcccaggtactctcaatcatctaacgcgtcttttttgtctcagcactaaacaccctgatgttttcttgtttatttttatgttgatttgttcactattatcctctcccctctccctcctccctccacacacaaagagaagagtcagggctgctgtgatcacccaccacaagtactgagtgaatgactccacctaggtcctcttaaaatacttgttatagggagttcccttgtggtgtagcaggttaaagatccagcgttgtcactacagtagctggggtcagtccctggcctgggaacttccacatgctgcagatatggccaaacaacaaacaaacaggcaaacttgttatgaggtcagtctgatgaaatggtccaacttgagattatcccaaatccactatgtgaaaaaagaaaggtggaggtggggagagagagagagacagagagggaggaaattgctccagtgaaatttgatgtatgagattaccaggcagctttagtttaatgcctattaatatctaactaatttcattttctctttacttgtattaaacaatcttcctgtgttttatgcacctctcaaagatgacatgttataggaaaaacgtggtagaattaataaatacattaaaatattttgcttatgtaacttttgagtatgtgatttctccacaaatttctttaggaatgttaaagatatgaagtctttgtttctcaagcttagttcatcagtttctctgagagcactttttttttttaatttattttattttgtttttttctagggctgcacccgtggcatatggaggttcccaggctaggggtccaatcagagctgtagctgctggcctacgccacagccacagcaaggtgggatcccagctgcgtctgcaacctacaccacagtccatggcacagagcaaggccagggatggaacctgcaacctcatggttcctagttggattcgttaattgctgagccatgagggggactcctgagagcacttctttaaaatacaactttctaggcttcttcatggaagattcactaagtttggggtggggtccaatagtctgtactcggcttcccagctgattctgctggttcagtaggtttggggaccaatatgtaaattatcttccagcatcatccagcaaaaaacatcaatggttcattctactgctgcaaagctcatcactgtgaggaaaatactttaaagaaatgtaagattttacttaccatttgctgattataacgttcacactaa

SEQ ID NO: 35 - DNA, 8803 bp, Artificial
  ss284 sequence
tgaaataagaactaagaactagaagactgatgcccctcccagctggaaaggcagctatgtgcctgtcagcagctttgttcaccacataccagccccctagcaatcataaagcaaccaggcacctacatgactgtcagcagctcccctcatgacacatcagcaatcttgtctagcagccccctttcccctagtcggaattgcctcttatcagttccacttctgttaatattgcttgctacccaggaaagggggagggccaaggctgctggcatgggaaaccttcagaccctgaagtctgtattgctgaaatgctacccagaacaaagacctggtactcagactttggaggtgactcctctgaacccgcaggggtgctgaataaaccttgctatagatcacatctccgagtgctgcttgtctctttccgctgccatggtttctgcagcattttctggtgcactggccaggaagccaacaactgagctcgccccttgtgccaccattgtctgtgaaccggagaaggccacaattgccagcccgttgcacccagccgttttgctggatcctgaccctctcttgtgtcatgcacaccggatcctgaccctctcttgtgtcatgcacgccgctaatgccgctttctgaaagtattcagaaggagagcggaaacaggttccaggacaagacatcagactggtgagtgccctggagtcatttgcctgagtcaggacacgccatacagtggaaggagagactgatcacctctcagtgaccagagagtcactcaggacaggatttattcccttgggatcgggtggcttgtcaattctagtgtgcatgtgtgagtgactggagtgaacgagagcccgtgctccaccgtccttggactgtggaactagagtgggtcctgcagttctgtggtgatcctcatacagcttatggtggccctcttcagaggggtcctgccattggggtttcatatagtcccaccaatgctaagaggcagctgaaatatctcctccgggagagcagtgagacagatgaaagcaagtgtttccttactgtttgtcttgtgacactgttacagggtgggaatttacacaatcggtaaattggcttcaaaacccactgtcttagaatgtatggttaggaattctaagaaaggattttctgaagattatggtgttaaacttagttctggaaaactgcgcactctctgtaccctagagtggccctcctccagggtcagatggccctcacaagggaccttagatgtgcccaaggttccaggggttataacaggagaagaccctggacacccagatcaatttccattcatccatcaatggttagaagttgcctggttgaggcctccttctgtatcacaggcctgggacagtgtaagggcctagtagctcagtccaagaagaaaacttttccatgacaaaaagagccaccttcaaggagaggccaaagactcaccccttgtgctgcctccctatgagctaccagccacagcccctcctttggggtcccaaggcccccaattgccagacagcccactgccttctgtttctccctctccccctcctgaagtccccaacatcggaactggtgagctggtgtctctagttgaactagggagcagctgcccagcattacaaatgcctttgcgggagacacagggaccacggcgtattgccccttatgggaccatacaagagagaggaccagtttttaattaccagcccttttccacaacagaccttctcaactggaagcattacagtccctcttactctgaaaagcctcaggcactgatcgacctcttagaatccatttttcagacacaacgccctacgtgggtggactgtcagcagctcctgaagagcaccgatgaatcattatggaagccaggaatggctccaaaccaatgccccaggggatcaattagacatggaaaactgggcaagggatgctttcccagaggaagagccccattgggaccacaacaccgaagggggaagaaataatttagggaggtacagacaggccctcctatagggggtaaagatgggggctaaaaagcctactaacatggccaagaccactgaggtactacaaaagtcagatgaaagcctggccaacttctatgagaagctatgttaggctttttgagtttgatcccaagacccccaaggcccccaaggaccaatggatgataaacactgcctttgtgggacaggcccaatctgatatccgtaaaaagttacagaaattaggatttgcaggaaaaaatgccacaaagttactagagatagccaacaaggtttttgttaactgtgaccaggtggcctgctgtggcatggaaaagagtaggaaacaaaaagctgtgcttctggcggcagccctatcaaaaatggtacccccagcaggaccacccgtaagccatggggcccaaggccaggataaaggggcccccttgggcacaatcaatatgcctactgcaaagagaagggacattggaaaaatgaatgccccgactgtcctgagagaaagaccaaggcagcagccccacttagccagtaccaacccaagacatccagcatgagtctgatcggcttagctgaagcagagtccaactagtggagagtgggctttctccaactgggcccctgagacaccatggtcagaattcaagtagggggctgacccatagactttatggaagatataggttctgaacattcggtggtcacacaacccgtgccccccccccccggggaaagaatctaccatcatcagggcctcagacaaccaaacccgcaggcccttctgcagtccctgacagtgccagttaggaggccatgaggtaatacatgaatttctttacctgcctgactgcccagtccccttgatgggaagagacctgctggccaagatgggggctcaagtctccttctccactgatggatcagctcaactcaaattagcagaactgccctcttctttaatgatggctctcactataaggagggaagaagaatggtgcctgtgctcttcccctccacaagaggggatggttccactggaactagagactgagtacccattggtttgagctgagggaaaccctctgggactagcaagatgccatgctcctatcttgattaatctgaaacctggagctcaaccagtaaagctgcagcagtacttgattcccagagaagcttgaccaggaatccaggcacatctggataggctacttcagcacaggcttttaacaaagtgccagtcaccctggaacaccctcttattgcctgtaaagaaattgggaacacaagaccaacacccggttcaggacctgagggccataaatgaagcaacaatcacattatacctgtctttacctaacctgtacaccttgctggggttaatcccttccactaccaaggggttcacttgcctgaactcaaaagatgccttcttctgcctctaagtggcatctgcaggtcagcccttgttgcctacaagaattcaaaacctctcccactcttttcagcagtgccctggctactgatgtggctgaattccctggacaaaaactagactgtgtcttgctggagtatgttgatgacctcttggtggccagcaccatgccggctcaatgcctagagggaacaaaagctctcctctccctactaatggaagtagggtatcaggtatcaaagaaaaaggcacaaatcttaataaacaagtcaaatatctgggctttaacatcatgcagggccaaagaatattagggactgagagaaaacgtacaatttgtgccattctggcccctatcacccgccagaaagttcatgagttcctagaggcagtgagattctgcaggacatggatccccagattttcagatgtggccagacctctgtatgaagccacaaaaggggaagaaaaggctccccttgaatggggaccaagccagaaggcagcctttcagtcaatcaaaaccaaactcactgaggatctggccttaggacttcccgatgtaaccagagaatttaacctctttgttcctgagaaaaatgggatggctttggaagtcctaacccaagagttcaggccttggcagaagccggtggcatatctgtctaagcaaattgactcagttgcagctggatggcctccctgcctctgagctctggcagctaccaccttgttagtaagagaggctgacaagttgacactgggacagaacctcaacattaaagtcctgcattcagttgtaatcctgttggacaataggggccaccattggctaatgcatgcatgagtgactcagtatcaagggttactatttgagaatctgcaggtaaggctggaagctgtacgaactcttgaacccagccacctttctaccagatgaagtggggcccccagaccataactgcttagaagtactagatgttttccagcaggcctgacttaactgacagaccactccaaaatccaaacctggttctatgtactgatggcagtagcttcatggaatagggtaaagaatggcaggatatgctgtggtgtctgactcagaagtgatggaagcagaagtgcttcctcaaggttggtcagtgcagagagcagaattatgggcattaatcagagtgctggagctcagctgagatgagtgagttaatatctatactgactcatggtatgcctttgcaactttacatatccatgaagccttatataaggagaggaaactgctgaaggaaaagggatcaaaaaccaagctaaaatcctaaagttcctggaggtagtatgggaatctaaagatgtggcagttatacactgcaaaggccaccaaaagggaggtgacccagtggcaaaaggaaaccacaacactgatgcagctgccagacaagcagccaaggggcaatcaccagacaaaaacccaaagtcctgttggccccagaaataccgactatccccaagtactctctagaagaggaaaagtggatagaagaggaaaggggaaccaaaacaaagatgggatggtgggtcacacaagaccaccaggtttatcttctggaacagctggcctagaaactagtcccccggcaacacaaactgacccacatgggcaaaactgccttagagatcttactaggtaggtactatcttattgcacgtcttcccgcactctgctcctccatctcccaatggtacataacttatttacacaataacgctttctaagggcctagcagaccagctgggacacaaaactgtggactgtccccatttgaggatatggaagtagacttcactgaagtcactccgagcagggtatacaaatacctgctagtttttgtctgcagctttttgggtgggtagaagcctttcccaacctgaattgaaaaggtaagagaagtaaccaaggcactcttgagagacatcattctcagatatggaatgcctgggaccatcgggtcagacaatggactggcatttgtggccaaaaaagtgcaacaggtgacaagagccttacagatctggtggaagctacattctgcctgtcaccctcaaagctcagggaaagtagaatacatgaaatgaacccttaagtagactctagcaaaattattgcaggagatcagcttgccctgggttaatatgctgctggtggccctcctaaaagtgatatgctaccctgagtgaggataggattcttgccatttcaaatcttatatggaaggccacctccagtgatcagtttgagaggaaacaccagagaatggagaggcttatatttacatagacaattgcaaggattggtgctcactatctcacaaatacacaaatgggtcacccagatagaatacctgcatctctgggtacaacagtatacccccacaagccaggcgaccaggtgtggataaaagactggaaaaaggatcctttaaagccagtatggaaagggccttatactgtgatcttaaccacccccactactcttaaagtaacaggaatagatagctggtttcatcattccagagctaaaccaagctggcccaaactgtgactgtagggaatggagggctgccttgatccagagaaacctttatgcctatatagagaaggagacaacaatctcaaagccctgcactgaccacactagaagctggtcagtcaacacacggctgaagcttgaggagtcgtctgcccagtgaaatagactgtcttattttctatagagactttcttactgtcatatactgttatcctatgcccaacatgtatgtttgctgtttactgttattaatctggccccccttggccctgtcagcttccatttcctcatgcgacccatgcattcaggtaatccgatcagattagggaattacatggacttgactactcctttctcctgttggggagaaattcaaggaagttgtactcacaccaaagccacttattctactgtcaacacaagggccaatacacttgctttgatccccagtactcacccactgaggaatggttagaagtttaccatgcttggcgctctcataaggcagggcacctgattaattggacccaaatcacctaccccagttgccaatgtcagtactttttgatgcctgtgaggctatggatgggttatggatttctaccataccatgtgggagtctatcgtgggaaagagactacaggctcctagataaggatatgtgctattattccactatgaccgcctggaatggttgccaggatgacacagagttctattgcccttactggggctgtgagtcctggacaacttgggataaaagaaacaaaacagcagtccttcaaaagggcacgcccctccatactgtcagactgatttgtaacctagttaatttcactatttatgattcctgtaagcccaaatggaaggagggtctcacagttggcatatgcattaatggaaaaggcactgaccctggagctctgttacttttccagaaggtcatacttatgctccaagctgcctcccacagagtcttcctttctttttacgagaagataaagaacaccccgcctcccattttacccacaactaaaaacttgttttggccctggcagagaccatccacaaactctaaaaatctcctcttgttatgtatgtggaagaacaaacacaggagaccacttgccatggcaggctagaggactggacctgttggagcctcatagtgaaactgcatacccccaacccaccaatggggtatggctcctttaaactgctattatagggaaaaactgccttgtgaggtggggaggactgttcagtgtgtccgttgggagcctaacatgtttaggcctaaggttttataacctaactgatcaaaaaatgcaatggtgggcatcctccaaccttccagagcccaggcccgatcctctgtctaactttacctgccttcagcaggcttgggaaaaaaaaaaatgtcagtgctgatatccaatggcaatggcaagtgccagaaggattgtattgaatctgtgggaaaatggcatattcccaactgggcaggagcatgtgtgctgggaacaaacagaccatctttcttcctgctcccactgtccctaggggagcaactgggaattcctatatataggacacaaggcacccatagagaccaaagggctctccagattggagactaggatgatgaatggcccccaaagtggataatccaatattatgggcctgctacttgggcaaaggatggctcctggggatactacacccctatctatatgctgaactgcatcatcagactacagagagtattagaatttatcacaaatgacactgcaaaggccctaactatattagcccaaaagcaaactaaaatgcgtaatgtcatctaccaaaaccgcctggtttggattatttacttgcttctgaaggaagggtttgtggaaagtttaacttgagtaactattgtctgcagatagatgacacaggaaaggtgatagaagaaattgctgactgcatgactaaaattgccgatgtgccagtacagacttggaagggatgggatgctaacagtctctttgctggatggttctctggctgggaggaattaagacaatggccggaatgatcatggttatactcgcagagtgcccacttattctttgcctcataccactcctaatgaatgttataaaaattttcatagaaaccatggttgaaagaaaaacagcctccaatttactactcatcaaaagttaccaatgggtaatgaccaatgatgaggagggtctctgaatggatgcagaggcatcttggacaagcaagaagggggaaatgaaataactagaaaaatgatgcccctcccagctggaaaggcagctatgtgcctgtcagcagctttgttcaccacataccagccccctagcaatcataaagcaaccaggcacctacatgactgtcagcagctcccctcatgacacatcagcaatcttgtctagcagccccctttcccctagtcagaattgcctcttatcagttccacttctgttaatattgcttgctacccaggaaagggggagggccaaggctgctggcatgggaaactttcagaccctgaagtctgtattgctgaaatgctacccataacaaagacctggtactcagattttggaggtgactcctctgaacctgcaggtgtgctgaataaaccttgctatagatcacatctccaagtgctgcatgtctctttctgctgccactgtttctgcaaca

SEQ ID NO: 36 - DNA, 5517 bp, Artificial
  ss5 sequence
tcccactgtgttcagggctcagcctttggatatgaatctgctgaaccagtgctggcatgaataaatgctgcttccttgcaaaaagccttggtgtcccatctctctctatgagaatcctacatttcttgggggcttgtctgggatttggagatggtgattacacctcctttgtcaccaggatacaaccccttggacgctgggagaggtgacgtcatctggacgtccgtagggaactaatccgtagggaactagccctcttggcatgtaagagcgaggaccccaggagcacaatggaacctggtgaggcccaggaaccagccaagggggtgccatccgtcagactggtaagaacccggtttcgacttggtagcctgccccaagaggcagaaggagaggctgatcacctccctgcgttgcctgaataatctcataggaggtgaaatctcaactctaaggcgctgggcagcaggttggagacgttgtctgaatgtgagtgaatgagacagacaatgggagagttccaactagaccagacaggccatagcaagtgttgagtcctgacccatggttctgtggtgatcctcatacagcttatggtggctctctttggagaggtcctgacattagggtttatacagtcctaccaatgctaagaggcacctgaaatatctcccctggtagaatggcaggagatggatgatgcaattgataactgcttccctttcctctccttgtgtgtgactgtcatcttttagggggaggaaataggtggcaaacagagtaaatatatccccttagagtgtatgataaaaaaaaaaattcaagagggaatattcaagagattacagtattaagttgacttctggaaaactctggatgttctgtggccttcgtttggggtgggttggccctccgagggatcactagataaagaactagttagcaaagtgtttagagtcatcacaggagacccaggtcaccctgaccaattcccttacattgattgctggattgctggcaagatatagtcctttcttggtcatcttggctgaaagcctgtctggaagagaactgtaaaattctgttggcttgaatgatagcctcctcaaaatgccaactggaactcgagaagcccattttatctagggagccagaggaagttcccccaccttatgcaccattataccctccactgccacctgcacttccagccagggccatgccagaggctgctgcctcccctgagagcaccgcctcccctgactcacccatgacatcaccagtcaccaccagttccaagcctccagtgttaatcccatatactctggccagaggcaactggcatatcaggccatcagtggcagcccctcttcaccacagtaccagagggccctgcagatgccactgagagagaccagagggcctgtctattttgatcaagatggccaaattcaaggaagccagcatgtttttgtgtaccaacccttcaccaccactcatcttctaaattagaaaaatcataccccctcctacacaggggagccacaggcaatgatctagtacagtccatcattcaaacccacaagcccacctgggactgattgctgtcagcttctccagactgtttaacacagaaaaatggtgctgaattattcaggcagctctaaaatggctagagggaaatgccctggaaaaaatactagatgcccaggcttatgcccatgacaatttccccagggaggaccgccctccccccccgcaatggcacactaatgaagggggacttcctcaatttgcatgctaccatgaggtgctcctaattggcatgaaacaaggtaaaaaagggccatgaacatgagcaaaacttcagggttactccaggggcctgatgagagcccaagccaattttatgagaggctatgcaaagtattccacctctatacccccttcaaaaacaaaagcagctgaaaaccagcatatggtcaatgcagccttcatgagctaggctcaaggggacatccaacacaagctccagaagttagatggctttgcaggcatgaatgctagtcagttgttggagatagcaactaatgtgtttgtcaactgtgaccaggcagcactaaaggctgaaaacaaaatatgcaaaaaaaggcaagccttctggctgctgccttggtgaaacaaatggaaggttccccacagagccgaggtcgaggccagaaaaggggggtaatgaggaggaccatctcgcgtagggccaaaactgggtcagaacaaatgtgcctactgtcaccaggaaggccactggaaaaatgagtgcccccaattgtcataagattaccaatcaggccccaaacagaggggaagaggccaggtggtctggggctgatatcagctggcccagcagccacatggagcgtcagaaaataattttttagggcttgccattatgaaactatgaggagtacgaggacagactgggctctattttgctaggctcctaagagcctatggtctgaatgaatgtagggggccggcccgttgacttcatggtagatattggggcagaacactcaatggtaactcagcctatgggcccactctggcagaggcaaaccaccatcataggggcctcaggcaaccaaacatggtgtcacttgctgctgcctagatgatgcactttgggggaatatgaaatcattcatgaatttctatacttccctgactgtcctgtggctttgatgggtcaggacttattgggaaatctacagccccagataactttcaactcccatggccaaatggccctgaccctagggaagccaggggcaaagatcatgactctcacagtccccccaaggagaagagtggtgcctcttcaggcttatagagaggccttgacagggaccgagcttcccttcaagctgcccagggtatgggctgaagacaaccccctccccagactggcccaaaacataccaccaatagcagtggagttaaaaccaggggccgagcctccccaccagaaacaatatttcatccctcacaaagcacaaattggggacccagaaacatttggagagacttctaaagtatgggatcctcctacactgccagtcatcttgaaacatacctctcctgccagttcagaaaccagggtcagacagccaccggccagttcaggacctttgagcagtaaaccaaggcactgcgaccctgcacccagttgtccctaacccctacacccagttgtccctaacccctacacccagttgtccctaacccctacactctcctgggccttatccctgctgaagatgcctactttacatctctggacctcaaagatgctttcttctgcatctgcctggcacctcagagtcagccaatctttgtcttccaatggcaagatccagaaaacggtgacaagggtcagctgatctggactaggctgcatcaaggattcaagaactctccaaccatctttggcactgcattagcttctaacctaaaggccttcccagcaaaccagtatgacttttcgatgctccagtatgtggacgacttactactggctagacaaacacaggagaactgtatggaagggaaaggccttccccactagcatgaggagaaggcacatgaggtggcctgatttctaaaggaaattattccctgatcttggattccaatcaccattggatcagacaatgcaccaacaattgtggtagaaatggtggcaaagggatgaaagatcatctggaaattgctcacagcctattgactccagagctccaggaaggtgaaatgtatgaatcagactctgaaactgcaattaagcaaactgtgccaggagacaaacttacactgggaccagttcttgccagtgccttgcaaaggattagatccagccctactaagcagacagggttctccccttatgaaattctctatgggtgttcccctcccgcctcctctcattaaggatataagggggaacttaaaggaactaggaaacctcaccctgaggcaacaaatgcaggtgctaggttctacctgagccacactccatcagttgtttaaggaatggttacctgtaagcctaaccacagacacccaccccttcaaaccagggatgctgaaagggtaaaagaatggaatatacagccactacaacctcttcggaagggcccatttactgtctttttatccacctccactgcagtaaatatagcagaagtggttccttggattcactacagcagagtaaagccagtatctcgagacagggagtgtgtccctgatcccttggcaccatgtaagctgaccatccgaaagaagcaagctgcagctccagagagccaagaggatgacagccctgctctagtcactccagaagctgtgtagtttacatggcagaagctggaggaattggccacctgatgggataaatagactggttttgttttctatttcagttttcttactgtgatacactgtcacctcttgtccctgtctgtcgttgtgatccttgacctaatcttcaccatagggttggtggaagttgccctggcagactaaaaatatgacaaaagacctgggacaaagtcgacacatacatcaaatggtgggccccaggtggactatactggatatgtgggtggacagcctatactgtacttcccccaaactggtcaggatcttgtgtgttggtgtcaatcctcccatctttcttcttgctcccacttgccagaggggaaaatttgggagtccaaatgtatgaggactgggagacccagagaaaatggtgtgccctacaaactgtcaaatgaaagatgacaaatggccccctgagtgtatgttcattactatggtccagccatctgggcagaggatgggtcttatggataccgtactcccatctatatgttaaactgcatcatcaggttacaggtgattgttaaaaatttgtatgagggattcaaaaccctcataggtgctatgttcttaattttaggagcttgcctaatcctaccctgtctagctcctctagttataacatccatctccagcctcattgaggccatggtcgaaagaaaaacagccacacatgtgatgatgctatggaaatataaacccctaaaccaagatgatgctctttgaactccaaagaggggtccaagcatcaaagggaggaatgtggtaggagccttcccagaacaaagggaaggcaacgtgcacaaccagcatctgtgtacacatgagtaactctgtggcagcaagacattatcagtgtccatgtgcaactttgtagcatcaaccatccaaccagaatttacagaatgaatgttactttataagggggacaaagggacagaagtgtatataagacagtgccctgctgtgctcagggctcagcctatggatatgaatttgctgagccagtgccagcacaaataaacactgcttcctggaaataagcattggtgtcccatctccctgtacgagaatcctaca

SEQ ID NO: 37 - DNA, 9986 bp, Artificial
  ss10 sequence
aggcactgtcttacttctcagcactattctctctctctctctcattttctcattgtctgttgaattgtcagccctattgtttcaacaatgagtggaggttgagccttaaaagccattagggcactttccatgagaaatctcctgtgaaagaataagtgggttgtggaatggattaaagaaatgacagttctgactacctcaagacagtttccatgaaatattttaggcacacaattaaaagcatgacactgtcccctccccttggctatcattataagcttataggtccacctatgcctgactatccttggctcatgtctacatccctatatcactcttatttcactctcatttcgtgccttactccactggaaattggggaaaagaaagctggcaggcattttccaaccatgatgctaggtcctccacttctcattgttacacaggcacagggcatgtcagggaaaaattttgaccagtctcattggcagctagagatccataccataggacctttccctctgggtttgccctatccaccatttaattaacttccatcaggttcaatttctagaaatataaactgcagccttacttagagagttcatgtcctagttgtagtcactgggatccctttgggagttccctcatgcttgggtggtctgtgtgcttacccctgggtgtttaaggagtaggggtggaaggatgggcctgtgttatgtagctgagactcatggaggtgagccaacatctgagctaccattgtccacagcccaactctaaatgccacctggcatttgaccagctccctccagggtccacagcacatccagggtccatacccactcccaatctacctcactccattgggtaccccagggatacacaccctggtgctgacccactgatactgcacttgcctgctccagtcacatgcaataggaagtgtcttatcacagctgcgagtacctctgtccccctaaaagcagagagagttcctccaactcactctgccatatcccctactatacctggccataccacactgctggccagagtatgggggggaagagcacaggaatggtggcactgaagcctggaggtgctgcccacaaaggggaagagaaacttattttcttaaaagtctcctaaagagattttcattttacagccactgcctgttttcagaaacttaccaccctggaacacagggattaatcagtggccatagaatctatagagaagccttcaggaaggtcactcatcctgcgtaccatagacaatgggataggacacaggccccaggatgctgaggccagcatgactgccacatggggagtagctgactcccactgtgactagggttgatgagagtaggcacttgagaatgcctagaaccagtcatgtcttaggtagccccatgggaccttgtaatgctagtgctcctctctgttacagaagaatcctcttcctgaaggaatgatgggaaacacctgctccatcaccaaggcctcaccccatcaggtatattctgaggcactaggataatttttctataggttctttaaaatgagaacacagcctggccccaatataaacttgaggatgatgaggcctggctagaaaatggaagcctcatctataacaccattctaaagttagacattttttgcaaaaggcagggaaaatggacagaagttccttatgttcaggtttttatggccctaagagagaacctgagctacatgagtcttatgttagggacccttgctggttgggacccatgcaggcttaacagaagccctctatagtggcattcctggagtaacacaagcttcagactgaagacccaatccctgacactctttccactctttcacatcttcatctccttctccaccctataagcctctttaaccttctaaactagaagtacagccaaagcttctttgccccctttaggaagtagtaggagggcctctgggcattaccagagtccacacccctttttctttggcctcaaccagtgccacactcagagtgattcttggaggactctagctgtttcactgaagaattctaggtactctctccttcgatcttacctgtaaagacctaaatattgtcctttcactgctgcatccctaaggaaaatacctgaatttgggcacagcctcaaacatattgcccaacctcatcaatatcctgtgggcatgacagcagtgcctctaatgtatcccagttgggactattggccaggccagcctggtatcactagaaaggatcacatgagttttagcctcattgaagggatggaatgatgtataattaaatttgttaactatgataaggttaaagagatcacccaaggccaagatgaaaatccagccccacatcaggcccaactggtagatgcccttggaaagtacacgaatataggtccaagaacttttgaggggcacatattattttcagcccacttcattagccaatcagcccctgacatccattggaaacttagaagcttgctatgggtccccaaatccctctcaatattcttactgatacagatttcagtttctttaacaatagagaccaggcttaggtagaaaggaaggaacagtgtgacttaacaaaggaaaaatggcaagccaaagttcaggcagccatcataacaagaccttacccacctgctggtcacctcagtccccccaaaagtactcccaaaagaccactgccaggaaaggggcctgttttaactgtgtgagacccaaacgcaagagcaaggaatgcccaggaaacagatcccagcctatgcccaaaataccattatcaattctgtaagaagatgggccactggtagaaggaatgtccccaactccaaagagagtgaggaaattctcccctgtcagtcatggcagtggttgactgatgggacctgggatctcccaaggctcctgagaatacagttgtcatcacatgggaggaactgagggtgaccactgatatagcaagtaagcttgtccagtttctagtgtatatgggagccacttactctgttctgacttctcacactgggccccttgctcccaaaacctgctctactgttaaggtagaaggaaagccaaaatgaaaacatttcatcacccctctaacttgtacatgaggaaagacccttataactcataagtttcttgtcatacttaaatgccccaacccattattaggaagagattttctctcagccttggatgcaactcttactccccctgaaaaccaaaaccaaggaacatttttggctggactacatattatacaagacatagtctgcccatctcaaaatatttgccccaaaattgaaacacttatagatccataggtctgcggtcaaggaagacaactgtttgtcacttctataaagatcaccttaaaggagactaataattccccttccaggcaccaataccccataaaacaagaggctcaatgaagcttctaacacttaatatcaaaattcatcaaatatgggctcttggtgccatgcctgtctctctataatactgcaatcctatctgtccttaaaccaaatggggaatatagaatggtccaaggtctcctagtcatgaatgaagctataattccctttcatccaactgttcctaacacgtacatagtccttactcagatctccaaggacatagcctagtttacagtccttgatgataaagatgccttcttctgtatacctgttcaccctgatacccaatatatttttgcttttgaatggactgacctttacattaatgaagccaaataatatacctggactatccttcctcaaggattctgggacaatccacacctgtttggcaatgccctaagaaactaagggaactaaagtttgagatggggacattcttacaatatgtttatgaccttcttttctgtggcccctcaaagtttcagatcaaaacactgtacaggttctcaatttcctgggctccagaggatataaagtatctccatggaaaacccaaatttgctcccagagagtcactcacttgggacatgttccaagcccagagcagcacacccttatgacccagaataaagaagcaatcctgtgtttacaaccaccacatacaaagaaacaactcaggagttcccgtcatggcacagcggaaacagaggtcagttctggtgagaggattgggttttgtgtgtggagactgcctaaggggctatggaggaggttgtcatgggctggggattggaacaccacagctaagggaacccagggggaggcccaggccctcaggagaagccaggcaccattgcaagaggcggaggaatggactgccataggaatatctttccctgtgcacatgtggactctcagagggcagggcacctctggcaaaagctatgggtggtgaagggccaattgcttgggctataggcaacagggcaccacttgtgtgggctatgggtagctgggcacctcttgtgtggactaagggcaccggggggctaagtgtgatactctgccttttgtgtgatctacaggcagcagggggaaaccacagcagtcatctcagatgggcatggtctttcaccactaggggtctgtgaacaggcaccatatgcagacccaagcacctaagaggctggcaaagaagagggcactgcaaccaagcaccacaagttgttactctcactcccctgggaatggcacctgccctgcggctgccactgccacatgacccagtaaccacctacactgcctgatcactatcacatccaagggtcttgcaactaggagcaggctgtgccaccttcctgtgggtccttgccactgtcaaaggcccagtgaccatgcactaactactagccctgcccattgcctccatctccctggaagcacacacaagaaataaaaagtaagctctcacaaaatacccagaggtgttcacacatacaaataactctccaagactacagcagttgtttcccctaaactcaaagagtaagaaaaatataagcaatacgaagatgctcaggcaccattcccagttaaaagaacaggagaaatcacaggaaggagcaaacaatgaaacagacctatgcattccaacagacattcagttcaaaaaggagatagtgaaaatactgaaggaattaagagcaaatatgaaggaattaagagtggatatgaacagtaacgcagattactttagaaaggaactagaaaataaaagcaagagttaagaaaattagaaaattcatttacagagacacaaactgagttaaaggtacaaaaagagcagaatgaataatgcagaggaaaaaaattagtgacttggaagagagagtaatggaaatcacccagtcaggacaggagacagaaaaccaagtgaaaaaatatgaaagcaatataagagatctatgggatgatataaaagaaggccaatatacctactacagggatttgaaaaggaaaggaaaggagctgaaaacatatttgaagaaattattatataaataatttaataataaattttaatttaaagacattgaaactttccaaatataaaggaaacctatatcaagataaaggaagcacagagggccccaaagaagttgaatccaaacaggcccacagcaagacatattataataaaaatggcaaaagttaaagataaaaagagaattctaaaagcagcaagagaaatacaaagtgttaattataaaggacccccataaggttatctgctgatttctctacagaaacactacaggccagaagggagtggcaagatatattcagagttctaaaagggaaaattttgcagcctaggatactctacccagcaagaatatcatttaaaatagaaggagaaataaagaatttctccaacaaacaaaaactaaaagagtacagcaatactaaacccactctaaaggaaatgttggaagggctcctctaaataaaaaagaagtaagaaggaataggatggaagaaagcacaatttgaatgcaatcatttaaataagcctgtatataggtctaaaatgaaaaaaaaaaaaacctattctaaaagcaatgataaacaccaggaacagcaaaaggacaaacaaacatgaagatattaaaaaagactttgaaatcataaaatgtgaggaaggaaagtaagaaaaaaaaaaaaaaccctagactcttgttttagaatgtgtttgaaactatatgactatcaggctaaagcaagcacatacaggaaggggttaacatacttgaaaaacagggcaaccacaaatcaaaaccaaacattacattcacaaaaactaaaaagaggaggacagaagcataaaataaaaggaaataatccaaccaaaaaaaaaaaaaaaaaaagagagagaaagggacaaaggagaaacatagaatcaactggaaaacaaggtttaaagtggcaataaatacatatttatcaataattaccttaaatgtcaatggactgaatgtgccgatcaaaggacacagaattgcagattggatttaaaaagcaatagcctacaacattctgcctacaagagcctcaccttagggcaaaggacacatataaactgaaagtgagggaatggaaaagacaggaaagcagaagttgcaatagtcatatcagacaaaatagactttaaaatgaaggccagaaagaaagacaaagaaggaaactatttaatggtaaaaggatacatttaagaaaaggatgttacaatcatcaatatatatgcccctaatttaggagcacccagatacatacaacaactactaacaaacataaaaggagaaactgataggaatacaataacagtaggagactttaacaccccactcacatcaatggacagatcctctagacataaaatcgttaaggcaacagagatagtacaggacagaatagaaaacttagacttcattgacattttcaaaacatcacatccgaaaaaaaaaaatcacattcttttcaagtgcactggaatattctcaaagactgaccacatactggggcacaaaaataacctcaacaaatttaagagtatagaaatgatttcaactatcttctctgagcacaatgtcatgaaataagaactgaatcacaggaaaacaaatgagaaaaaaaaacccgaccacatggagactaaacaacatgctacttaaaaccaatgggtcaaggagttcctgtcatggcacagcgaaaactaatctgactaggaaccatgaggttgtggattcaatccctggccttgctcagtgggttaaggatcccatgtttcgatgagctgcattgtaggttgcagacgcgcctaggatctggtgttgctgtggctctggcataggcagggggtgggggcaacagctctgattagacccctagcctgggaacctccatatgccgtgagagtggccctaaaaagacaaaaaaaaaaaggtcaatgaggaaatcaaaagagaaattttaaaaatacctcaagacaaacactctctgacatcaacatcatgaatattttctcaggtcagtctcccaaaacaatagaaattagagcaaaaataaacccatgggacctcagcaaactgaaaagcttttgcacagcaaaggaaaccaaaaagaaaacaaaaagacaactttcagaatgggagaaaatagtttcaaatgatgcaactgacaagggcttcatctctagaatatataaacaacttagacaacccaacagcaaaaaagccaatcaatcaatggaaaaatgggcaaaagacctgaatagacatttctccaaagaagatatacagatggccaacaaacacatgaaaaaatgctcaacatcgctggttataagagaaatgcaaatcaaaactaccatgagataccacctcacaccagtcagaatggccatcattcataagtccacaaataacaagtgctggagggggtgtggagaaaagggaaccctcctgccctgctggtgggaatgtaaactggtacagccactatggagaacagtttggagataccttagaaatctatacatagaacttccatatgaccccgcaatcccactcttgggcatctatccggacaaaactctacttaaaagagacacatcctcccgcatgttcattgcagcactattcacaatagccaggacatggaaacaacccaaatgtccattgacagatgattggatccggaagaggtggtatatatacacaatggaatactactcagccataaaaaagaatgacataatgccatttgcagcaacctggatggaactatagactctcatcctgagtgaaatgagccagaaagacaaagacaaataccataggatatcacttataactgtgatctaatatccagcacaaatgaacatctcctcagaaaagaaaatcatggacttggagaagagacttgtggctgcctgatgggaaggggagggagtgggagggatcgggagcttgggcttatcagacacaacttagaatagatttacaaggagatcctgctgaatagcattgagaactatgtctagatactcatgttgcaacagaagaaagggtgggggaaaatgtaattgtaatgtatacatgtaaggataacctgacccccttgctgtacagtgggaaaagaaaaaaaaaagaaaaaaaaatacatcgagacaaatgataatgaaaacacaaccattcaaaacctatgggacagcaaaggcagtgcttagaaggaagttcatagcaatacaggcctttctcgaaaaaaaagaaaagtctcaaattgacaacttatcaccccccacctaagagaattagaaaaagattaacaaacaaaacctaatgtcagagaaggaaggaaatcaataaaatagagattcaaaaaaatgatagaaaaaaattaataaaaccaagaactggttctttgaaagcatatagaaaattgacaaacctctgcccagagtcatcaagaagaggagagaaagaactcatataaacaaagtatgaaaaaggagaaatctcaatggacactgcagatatacaaaaaaaaattagagaaaactatgaaaaattatatgccaacaaatttgacaacctagaagtaatggacaactttctagagatttacagcctgccaaaactgaatcaagaagaaatagatcaattgaatagactgatcactagaaatgaaattgaatatgtaataaaaaacactccctacaaataaaagtccaggaccagatgacttcataggcaaattctactaaatatacaaagaacttatacccacccttcttaaacttttccaaatgattgaagaaaaaagaatactcccaaagacattccatgaagctaccatcaccctaataccaaccagacaaagacactatcaaaacagaaaattactcccttttgatgaatatagatgtaaaaaattctctacaaaattttagccaactgaatctaacaacatataaaaaagatcatacaccatgaccaagtaggattcatcccaagttcacaaggctggttcaacacatacaaatcaatcaacatcatataccacattaagaaaagtaaagttaaaaaacacatgattaggagttcctgttgtggctcagtggttaatgaacccaacaagtagccatgaggatgctggttcaatccctggccttgttcagtgggttaaagttctggcgtggccataagctgtggtataagtcgcaggcatggctcagagcccacattgctgtggctgtggtgtagactgatggctatggctctgattcaacccctagcctgggaacctccatatgctatggaggaagccctaaaaaaaaaaacatctcaattgatgcagaaaatgcacttgacaagatccaacatccattagtgataaaaactcttaccaaagtgagtatagagggaacataacatattaaaagcca

SEQ ID NO: 38 - DNA, 8156 bp, Artificial
  ss12 sequence
  misc_feature (4965)..(5064): n is a, c, g, or t
tggtgagccagccaggagaatttggtaagcctcagccttgcacctcctttgtgcttaagaggcactgtcttacttctcagcactattctctctctctctctcattttctcattgtctgttgaattgtcagccctattgtttcaacaatgagtggaggttgagccttaaaagccattagggcactttccatgagaaatctcctgtgaaagaataagtgggttgtggaatggattaaagaaatgacagttctgactacctcaagacagtttccatgaaatattttaggcacacaattaaaagcatgacactgtcccctccccttggctatcattataagcttataggtccacctatgcctgactatccttggctcatgtctacatccctatatcactcttatttcactctcatttcgtgccttactccactggaaattggggaaaagaaagctggcaggcattttccaaccatgatgctaggtcctccacttctcattgttacacaggcacagggcatgtcagggaaaaattttgaccagtctcattggcagctagagatccataccataggacctttccctctgggtttgccctatccaccatttaattaacttccatcaggttcaatttctagaaatataaactgcagccttacttagagagttcatgtcctagttgtagtcactgggatccctttgggagttccctcatgcttgggtggtctgtgtgcttacccctgggtgtttaaggagtaggggtggaaggatgggcctgtgttatgtagctgagactcatggaggtgagccaacatctgagctaccattgtccacagcccaactctaaatgccacctggcatttgaccagctccctccagggtccacagcacatccagggtccatacccactcccaatctacctcactccattgggtaccccagggatacacaccctggtgctgacccactgatactgcacttgcctgctccagtcacatgcaataggaagtgtcttatcacagctgcgagtacctctgtccccctaaaagcagagagagttcctccaactcactctgccatatcccctactatacctggccataccacactgctggccagagtatgggggggaagagcacaggaatggtggcactgaagcctggaggtgctgcccacaaaggggaagagaaacttattttcttaaaagtctcctaaagagattttcattttacagccactgcctgttttcagaaacttaccaccctggaacacagggattaatcagtggccatagaatctatagagaagccttcaggaaggtcactcatcctgcgtaccatagacaatgggataggacacaggccccaggatgctgaggccagcatgactgccacatggggagtagctgactcccactgtgactagggttgatgagagtaggcacttgagaatgcctagaaccagtcatgtcttaggtagccccatgggaccttgtaatgctagtgctcctctctgttacagaagaatcctcttcctgaaggaatgatgggaaacacctgctccatcaccaaggcctcaccccatcaggtatattctgaggcactaggataatttttctataggttctttaaaatgagaacacagcctggccccaatataaacttgaggatgatgaggcctggctagaaaatggaagcctcatctataacaccattctaaagttagacattttttgcaaaaggcagggaaaatggacagaagttccttatgttcaggtttttatggccctaagagagaacctgagctacatgagtcttatgttagggacccttgctggttgggacccatgcaggcttaacagaagccctctatagtggcattcctggagtaacacaagcttcagactgaagacccaatccctgacactctttccactctttcacatcttcatctccttctccaccctataagcctctttaaccttctaaactagaagtacagccaaagcttctttgccccctttaggaagtagtaggagggcctctgggcattaccagagtccacacccctttttctttggcctcaaccagtgccacactcagagtgattcttggaggactctagctgtttcactgaagaattctaggtactctctccttcgatcttacctgtaaagacctaaatattgtcctttcactgctgcatccctaaggaaaatacctgaatttgggcacagcctcaaacatattgcccaacctcatcaatatcctgtgggcatgacagcagtgcctctaatgtatcccagttgggactattggccaggccagcctggtatcactagaaaggatcacatgagttttagcctcattgaagggatggaatgatgtataattaaatttgttaactatgataaggttaaagagatcacccaaggccaagatgaaaatccagccccacatcaggcccaactggtagatgcccttggaaagtacacgaatataggtccaagaacttttgaggggcacatattattttcagcccacttcattagccaatcagcccctgacatccattggaaacttagaagcttgctatgggtccccaaatccctctcaatattcttactgatacagatttcagtttctttaacaatagagaccaggcttaggtagaaaggaaggaacagtgtgacttaacaaaggaaaaatggcaagccaaagttcaggcagccatcataacaagaccttacccacctgctggtcacctcagtccccccaaaagtactcccaaaagaccactgccaggaaaggggcctgttttaactgtgtgagacccaaacgcaagagcaaggaatgcccaggaaacagatcccagcctatgcccaaaataccattatcaattctgtaagaagatgggccactggtagaaggaatgtccccaactccaaagagagtgaggaaattctcccctgtcagtcatggcagtggttgactgatgggacctgggatctcccaaggctcctgagaatacagttgtcatcacatgggaggaactgagggtgaccactgatatagcaagtaagcttgtccagtttctagtgtatatgggagccacttactctgttctgacttctcacactgggccccttgctcccaaaacctgctctactgttaaggtagaaggaaagccaaaatgaaaacatttcatcacccctctaacttgtacatgaggaaagacccttataactcataagtttcttgtcatacttaaatgccccaacccattattaggaagagattttctctcagccttggatgcaactcttactccccctgaaaaccaaaaccaaggaacatttttggctggactacatattatacaagacatagtctgcccatctcaaaatatttgccccaaaattgaaacacttatagatccataggtctgcggtcaaggaagacaactgtttgtcacttctataaagatcaccttaaaggagactaataattccccttccaggcaccaataccccataaaacaagaggctcaatgaagcttctaacacttaatatcaaaattcatcaaatatgggctcttggtgccatgcctgtctctctataatactgcaatcctatctgtccttaaaccaaatggggaatatagaatggtccaaggtctcctagtcatgaatgaagctataattccctttcatccaactgttcctaacacgtacatagtccttactcagatctccaaggacatagcctagtttacagtccttgatgataaacgatgccttcttctgtatacctgttcaccctgatacccaatatatttttgcttttgaatggactgacctttacattaatgaagccaaataatatacctggactatccttcctcaaggattctgggacaatccacacctgtttggcaatgccctaagaaactaagggaactaaagtttgagatggggacattcttacaatatgtttatgaccttcttttctgtggcccctcaaagtttcagatcaaaacactgtacaggttctcaatttcctgggctccagaggatataaagtatctccatggaaaacccaaatttgctcccagagagtcactcacttgggacatgttccaagcccagagcagcacacccttatgacccagaataaagaagcaatcctgtgtttacaaccaccacatacaaagaaacaactcaggagttcccgtcatggcacagcggaaacagaggtcagttctggtgagaggattgggttttgtgtgtggagactgcctaaggggctatggaggaggttgtcatgggctggggattggaacaccacagctaagggaacccagggggaggcccaggccctcaggagaagccaggcaccattgcaagaggcggaggaatggactgccataggaatatctttccctgtgcacatgtggactctcagagggcagggcacctctggcaaaagctatgggtggtgaagggccaattgcttgggctataggcaacagggcaccacttgtgtgggctatgggtagctgggcacctcttgtgtggactaagggcaccggggggctaagtgtgatactctgccttttgtgtgatctacaggcagcagggggaaaccacagcagtcatctcagatgggcatggtctttcaccactaggggtctgtgaacaggcaccatatgcagacccaagcacctaagaggctggcaaagaagagggcactgcaaccaagcaccacaagttgttactctcactcccctgggaatggcacctgccctgcggctgccactgccacatgacccagtaaccacctacactgcctgatcactatcacatccaagggtcttgcaactaggagcaggctgtgccaccttcctgtgggtccttgccactgtcaaaggcccagtgaccatgcactaactactagccctgcccattgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacttttactcttttaagcaaacttttaatttaagaataatatccaagaggtgtgtaccgctggaagtgactttaatttcaaaagagaagtttaatttgcttcacaaatatatgctctccattccctcatctctgcaaagaccctgaccttccccttctcgtaccctctgacccctgatgttcatcacttccgggctgattcctgctgtgtggtgtcaggtgagtggagcatgccatttctggagttagctaatttcctgtggaatattccagaggttcctctacaccagtgcgtgtaccctcaccaggtaccttgtaaaaatgggcagagcttgggccctgcgctccatgaggttctgaccccgaagttatggggcaggcctggcgcttataacaagctctccaggggattctgactacggaggcccagccaacaaggtgagtaatactttgctttctctgttccaaaggtggagatgagccctgacaactggaggttgagctagatcagtttttatcttgtgatggggaggtgggaggcagcagtggagccctgtgtttttctaaccacacactaaattttctgtgtgcgtttaatcctcatttattttgctctgcttgagagccttctggtgaccttaaaattctaggtatgcctttaagaagtgacaaggcagggttcttggcttctgaggcctgggcaagtggccctcagctgctatgctaatcctgcaagaccaatgagaagaacagggaacccggtttgctttccttcccaatggagagaagcttcaggcatgattttcttatgcttcaaaacaggcactctagctgctttttgccctccttggggagccaccctcagattgagggaactttgcttcttttaagctccccatatgcatggtctggcctctgtcagctctgatccagagtgttccacctgaggagtggcaggttccattgatacagaacgttgtgtctagaaatgtccccaaagaaacaaccaagtgtggtttttgcctcggtgtgaatttttaaatccctttattctggagaggaatggcatagtaattctgtgctttctttctcctgatggtggttctcaaagagtggttcccagacccacctgggagcttgttacaaatgtagattattgtgtcctgcttcaggtgtagagagtcagaaacactgggggagtgagtctgggaggttgtggtctggcaagtcccacaggtgattctgatgtacactcagtgtgagaaccactgtctattaagcttataggaacacctttttactcaaagaaaaccttgctagttggtgagggtgcaatttcctgggttttatttgagtccctcagtgcagtggtgaggggaggtgtgttggacagagatgaagaggagagactggggctacaggttgaagaggtgttttcatgtatctcttgagtgtcttctgaccagggaaacattattgacaccagctgggggtgggagtaggggcaaagatgatggagaaaccaaatcttcatgtacttcatgtacttccaggtcagaggtcagaaacagcacagctgtttctcacactgggctatatcgatcacttgtatttaaataagttccgcatgttaccaaatgaatccagggttccactctttgcctcgtacataatcaatactcacaaacagtagaaaggaaaggtgacttgaatcggaatgcttgcaacctggggagatgatgggctctgtatcccctaaaaaccacctctgctcagccatgaaagagaaagaaggaagtaatcccaaacattaaaatagggggtcaactagaattaccagccaagccactccatgctccagacctactgaaactgtagataataaatgtgttaagccgctaaacttagcgtgatttgttattcatcagtagtttattatcttttagaatttctttctttttaatagaagcatttatagtcatagttttaattgtatattttctctaaatttcatttaactcatcccagttttgaatttatattttcattatttttcagaattaagtactttttaatttcttttgtgattccttctttgctccatagatatttgggaaaagttttacaatttctaaatgtgtgggcttttctaagttatctttgagttattaatttctaaagtttcactatgaccataatttttgaaatttagaataattatatggaaatataatactgactctattgaaacttgctttacagccaagcacatggtcagttttggtaaatattaatatctgtgcttgataagaataaatatttcaggagagatagtactctgcacatgtcaactgggttaagtttattaattgtgctgttcaaatcttgcatatccataatgatatatttgtatgcttgacctattaattactaagaaagttatattaaaatgtccctctatgacagtaagtttggcaagttttcattttatttctgttagcattttggtttatgactgaagttgtgctgtaattgtaaatcttaatgtaatacttttgtccctatgtgatggttgtcttaaagcttagtaaatctttttccataaagaaataaaataaaataggcggtcagagtcttcaccatcccccactgtgtgtaggcttgtcacctccttgtgaccttcctctaaaagatcttgttctcttgttcacacagtttgttggggagattactgaaggggaagctagggaagagatctggacaggtgttaattacttattcatttctacttctttgatctattgaaggaatcaacaagttaggcagttcccgttgtggctcagtggttaacgaatccaactaggaaccatgaggttgcgggtttgatccctggccttgctcagtgggttaaggatctggcgttgccgtgagctgtggtgtaggtcacagacacggctggatcccgcattgcagtggctctggtgtaggcctgtggctacagctccaattcgacccctagcctgggaacctccatatgcctcaggagtggtccaagaaatggcaaaaaaagaaaaagaaatgaaagaatttg

SEQ ID NO: 39 - DNA, 5885 bp, Artificial
  ss16 sequence
tgcataggaaaaacaagacctggaagtctgtattgtataaaagctacccagagcaaagacctgatgctcagactctggaggcgacgcctctgagcccacactagtgctgaataaaccttgctattccgcatctctgagttccatttgtctccttccattgccatggtttctgcaacattttctggtgcattggccaggaaactgacaactgagctggccctttgtgccactgttgtcagggaactggggatggccaaggtcgccagcccagtgacaggcggatggcacatgcctggccatttgccggatcctaacattcactcaggctgtgccaccctggctcatgctgcttcccaaatggactcagaaggatagtggaaacagcttccaggatgggacgtcagattggcgaatgccccgggggtgcctacccaagagtcaggacctgccatatggcgaaaggagagaataatcacctctcagtgaccagagggtcactcaggataggatttgtttccttgggatggggtggcctatcctgttatgtgtatgtgaatgactggagtgaagaagagaccgtgctccaccgtcttcagactacgaagcctgagtgagtcctaacctgctgttctgtggcgacctcatatggactttaaggctgaaccaggttctgagggctctcttccctccctgcgagactggtccaggtctggggtttatacggaccagccacatgccaagaggcacctgaaacctctgagaggggggcagtcaggtggacaaaattaagtactctcctgctgtttgtcttgtgacatcgtcacagggtgggaatttatacaatgggtgaatcagcttcaaaacccactgtcttagaatgtatggttaagaattttaagaaaggattctgagttcccatcatggctcagtggttaacaaaccctactagcatccatgaggatgtaggtttgatccctggccttgctcagtgggttaaagatctggcctttctgtgagctgtggtgtagacacagctcagatcccacgttgttgtggctctggcataggccagcagctatagctctgattcaactcctagactgggaacctccatatgctgccagtatagccctaaaaagacaaaaaaaaaaaaaaaagacagaaaaaaaaaaagaatggatttctggaaattatggtatagtctagagtcgccctcctttggggtcggatagccctcagaagggcccttagatgtgcccacagttcaaggagtatataatgttataacaggagaccctggacacacagaccaatttccatacattgatcaatggttagaaattgcccagttaaggctgctttgggttaggttctgcatcacagacaagggacagtgcaaggtctagtagtccagtccaaaaagaaaactctgcctcaaaaaaaggagcccctttggacatgatcaatgtacctactgttaagagaagggacactggaaaaagtaatgccccaaccatcctgagagaaagaccaaaatggcaccctgcctagccgataccaacctgagccattcagcacaaatctaattggctttgctggatcagaatccaactaggaggaaccaggctctctccaactgggtgcccaaaagcctgtggtcagaattcaagtagggggccatcctatagatacaggtagatacaggtgctgaacattcggtggccatacatcccatggctcccctcttgggaagagaaactaccatcactggggccactggggcttaaacctgtagtcccttctgccatccccaatgatgccagttagactattgaggtagttcatgaatttttttacctgcctgactgctcagttcctttgatgggaagaaacctgctgccaagatgggtgctcaaatctctttccctgccaatggatcagctcaactcacattaacagaactgccctctcctttaatcgtggcactcactgtaaggagggaagaagaatggcacctgtactcttctcctccagaagaagagatcattcccctggaactagagactgagtacccattggtttgggccgaaagaaaccctctgggactagcaggatgccacgctcctatctcgattgatctgaaacctggagctcaaccggtaaagctgtgacaatactcgattcccagagaagctccactgggaatccaggcacacctggacaggctccctgagcacagactttggataaagtatcagtcacctggaacaccctcttattgcctgtaaagaaactggggacataagactactgcccagttcaggacctgagggccataaatgagacaacaatcatgttgcacccatccgtacctaatccgtatatcctgctggggctgatcccttccactgctgagtagttcacttctctgaacttaaaagatgtcttcttctgcctctgagtggcaccccactgtgaaaatgggaaaatctacacactgggacaaaggagcagctcacatggacaagactcccacaaggaattgagaactctcctactctttttagctgcaccctggacgctgacctggctgaatttcctggacaaaaactagactctgtcttgctatagtacattgatgacctcttgctggccagcaccatgcaggcttaatgcctagagggaacaaaactctcctcttcctactaatggaggctgggtatcgggtataaaagaaaaaggcacaaatctctaagaaaaaagtcaagtatctggactttaacatcatgcagggctaacaaatgttgaggactgaaagaaaacatccagtttgtgccattctagtccctaccacctgccagaaggttcatgagttcttaagggcagtgggattatgcaagatatggatctccaggttttcagacttgggggaagacctttttataaggccctgaaaggaggagaaaaggctcctcttgaatgggaactgatccaggaggcagcatttcagacaatcaaaacccaactcactgagactccaaccttaggaattcccaatgtaaccagagaattcaacctcttagttcatgagaaaaatggaatggccttcggagtcctaacccaagaatttggaacttggaagaggccagtggcatatttttctaagcaaagtgactcagttgtggctagatggcctccctgcctccaagcactggcagctccaccttgttagtaagggaggctgacaagttgatcctgggacagaacctcaagtaaaagtcccacattcagttgtaaccctgatggacaataggggccatcactggttcatgcatgcatgaatgactcaataccaagggttactaagaaaaatctgtgggtaaagctggaagttgtatgaactctgaacccagctaccattctaccagatgaagcagggcccccagaccataactgcttagaagtactagatgaagtattttctagcaggcctgacttaactgacagactgctccaaaatacagacctggttctatatactgatggcagtagcttcatggaggatagaaaaaggatggcaggatacactgtggtgtctgagtcagaaatgatgggagcagaagcatttcctcaaggttggtcagtgcaaagagcagaattatgggcattaatcagagcactagagctcaggtgaaaccagaaagttactatctatactgactcacgatatgcctttgcaattctacatatccacagagccttatataaggagagaggaccccttactgctgaaggaaaagggatcaaaaaccaggctgaaatcttaaagctcctcgaactgtatgggagcataaataaatggcagttatccactgaaaaggccaccaaacaggaggtgacctggtggcaaaaggaaaccacagtgctgatgctgccaccagacatgcagccggggggcaactgccaaacccaaggtcctactggcctcagaagtgccaactgtccccaagtactctctagaaaaggaaaggtggataaaagaggaaggaggaaccaaaacaaagatgggatggtgggtcacacagaaccactgggtttatattatggaacagctggcctacaagctagtccaccagcaacacaagctatcccacatgggccaaactgtcctagagaccttactgggtcgctaccttattgcacgtcttcccacactctgctcctccatctcccaatgttgcataatgtgtttacaaaataatgcttgccaggagtccagcagaccagctgggacacaacactgtggactgtccccattcgaggatatggtagtggagttcactgaagtcaccctgaggaagggatataaatacctgctagtttttgtctccatcttttcaggatgggtagaagccttcccaacttgaaccgaaaaggcaaaaaaaaaagtaacaaaggcactcctgagagacatcattcccagatacggactgcctctggccatcgggtcagacgatggacaagcatttgtggcgaagacagtgcagcaggtggcaaaagccttacagatccaatggaagctacattctgcctatggctctcaaagttcagggaaagtagaacacattaaccaaatctttaagcattctctagcgaggtcatgtcaggagaccagcctgccctgggtagatatgttgccagtggccctcctaaaagtgagacgctcaccccaaatgggaataggattctcaccatttgaaatcttatatggaaggccacctctgctgatcagcttgagagcaaacaccaggaaattggaagatttagatttacatataaaactgcaaggattggggctcgccatctgacaaatacacaaatgggtcactgatagaatacctgtatctttaggcataacagtgcacccccacaaaccgggggaccaggtgtggataaagaactggaaataggagcctttaaagccagtgtggaaagggccctatactgtaatcttaaccatccccattgctctccaagtaacaggaatagatgcctggatccatcactccagagttaaacaggctggctcaactgaagactgcagagaatggagagacgcccttgatccagagaagcctctatgcctgacaatagaaaggagcaaacaacgctctcaaggccctgctctgaccacaccagaagctggtcagtcaacagacggctgaaacttgagtaatcggctacccgttgatgtttgtttcttgctgttattaatctgttgccccttgaacctgtcaggatccattctgatgggtgcagatgccccctgaacataaagaggggggaatgaagtaagagttttaactagagaaacaagtcactggctgaataagcagctacctgcctgtcagtagctttcctcccgacaaaccacccttcttttaatcttgtagcaactatgtatcttatgtccttgctagcagccctgctaactatgctccaagcattgtttatcagttttgcttttgtaatcttgcttgctcagcttcttaggagaaactctgtctgctccgagaagggggagggactgcttctgcaggaaaaacaagacctggaagtctgtattgtataaaagctacccagagcaaagacctgatgctcagaccctggaggtgacgcgtctgagcccacactagtgctgaataaaccttaatattccacgtctccaagggccatttgtctccttccactgccagggtttctgcaacaatattgcttacatgtagaatctaatatacagcacaaatgaacctatctacaaaacaaacagactcacagacatggagaacagagttgtggttgccaaggtgaggggggagagaatg

SEQ ID NO: 40 - DNA, 8973 bp, Artificial
  ss24 sequence
tgtgcttgtagaaagtaacataatatcttttctatcaaaggaaatcttttttttttttttttttttttatttctttgggttgctcccacggcatatggaggttcccaggctaggggtcgaatcggagctatagccactggcctacgccagagccacagcaacacgggatccgagctgcgtctgcaacctacaccacagctcatggcaacgctggattgttaatccactgagcaagggcagggactgaacccgcaacctcatggttcctagtcggatttgttaaccactgcgccatgatgggaactccaaaggaaatcttggttactccattttgatctagtttcggtttcagctgaaatgcccctgcaacccccttcctctttacctcttttcccagcaacagtttgtttcaattagccaaccaggaagaatgtgcgccctgacctgaccaatgagaggggacaggtacatcacctgcattagggataaataggggagggtcctttgttcagcgtgcacactttttggagtacctgcgcccttctgcagaagtaaagagccttgtcgagatttctccttgtccatgtgtctcactttctgacactggcaacccgagccagagctatcttaatttccaacagacttgggtggtcgtccgggattcggggtccactggactgtagactcttgaggaggggagacgcgtcccatggccctgttgcggtggccctgaattgagaagtcaattttggcaatttcggttgaaatcataaaatcagagcatgaccctcaaaggtctcgggtgagaccggcaatttcgagtgaaattggaggattgaaacacgatcttgggaaatggaaagtaagtcttcctaacttgtacctccacctggaggatcaaattccttcagatggtcctctgggattaatgttaaagtattggggcaacaatcgctggacgaaggacaaaaagatgggaaaaatgattaagtattgctgttttatctttacacggacacctgttctcaccccatctgtcttctggccaaagttcggattggatgaggattgggtctgtcagctacttattcagtttgtccagaacaagacaccggggtctcaggaggaaactgattatgctctctggtggtcttatttcctctcagagcctgggataagaaggaaaaagaggaggaaactcaagaacattcaaggacttcctctccttggcttactaccgccaccttacaatccccaaaatggcactggctcccctccagccgcagctgccactgcccggggaacacaagagggagaggggtgcagagcccaccgcacaggtgcaagggcactgcccctggtcatggagttagcacgagagggggaggggcgcagagcctattgcacaggcataagcacactgcccccactagctgagccagagcaggaaggggaggagcctagagcccactgtgcaggcacaagtgcactgccactgtttagggagtcagaacaggaggggggcactacaggcataggcacactgctgcaacctgcgggatcaaagcccggtgcctcaacaaaaccagaggatgtggcagagccttattccagacttaggagagagttaaaacaatgtcaggaggatattcaaaattttccttttcccactgctacccctggggatagacaagaagggccacaaatgctcttcccactacgggaggctcccttagatgggggaggaataggatatgtaaatgcccctttaaccagtaccgaggtctgaaattttaggagagaattgtgaccattgctggaagacccatatggggtagcagatcaactagatcaattccttggaccacaagtctatacatggtccaaattaatgtctgttctctggagaagaaagggggacgatttgaagggcagccatggccttgtgggagcgaacccatcctcctcaaccaggggaagttagggcagaaacaaaatttcccaacgaggaccctggatgggacaataacaatgtagtccaccgggggcatatgatgaacttgagaaatctaatatttcagggaattaaggatgctgtaccttgagctcaaaatatatctaaggcatttgaggtacagcaaggtaaagaggagagaccaactgcatttttggaggactcagaattcagatgagaagatatggtggaatagattctactgaccctctgggacagggcatgctcagacttcacttcgtaactaatagttggccagatatttccaagaagttacaaaaaatagaggattggaaagataaaccattagaggacctattaaaagaggcacagaaggtttatgtgagaagggatgaggaaaagcaaaggcaaaggaccaagatcatgtttgcatatcaacaaaaacaagacaagtcaaatcaaaggggtcctaaaaacaaaagtaagagagggtcacaatatcagcctcaccgctacccagaaacagggcataagggaaaggggaatagatggcaaggtgaaaacaagtgctttaggtgtggcaaactgggacatttcaaaagcaaatgccctgagtggaaaaaggaggagaaataatccctctcatgttatttgaggaggatgaggactaggggggtcaggggctctcaatagtgattgaccaacttaaaaatccacaggtgccctacccagagcccttgataaatttagagatagggccataccatgaaattatgatttttcttattgattgaggagtgtcttgctccttgctttgttatttgcccaaagggctttccccttcatatgaacaaatactagtatctggggtaaaaggggaaggattttccacaaaaattttagaagaaaccaaagtaaatttccaaaacagatgtgccaaaatatgcttcctttttattccagaggccggcacaaacctgtgcgaaagagacctaatggccgaattgggactgagcttacaggttacaaaaaaaactttacaagtaaaattgaatcttttaacctcgacagtggagggacaaattcaaccacaagtgtaggcatcagagggaagtcatgggggacttaaagtgaccccaattaaaatacagttaaagatccctggagacgtagtctggaaaaaacaataccctatccctctacaaagaaggatgggacctaaaccaattatacagggactacttcaagagggtctcttagaaccctgcatattttcctataatacccctattctttcttgtgtgtaaggcagatgggtcctatcacttagtccaggatttgcgggcaattaaccacattgttaagactaaacatccagtggtcccaaatccccataccctcctgagtaaaatttccatttgaccaccaatggttcagtgtaattgacttaaaggatgccttttgggtatgccccctggactcagacagtcaggacctatttgccttcgaatgggaggacccagtaacaggaagaagacaacagtatagatggacagtcctcccccaagggtttgcagactccccacatcttttcaggcaaattttagaacaggtgttgggagactttataccccctcacggggcctgtctactccaatatgtagatgacttgttactatcaaacactgatcaaaagaaatttagagcggctacagtttcccttctcaattttcttggggaacaaggccttagggtctccaagaagaagttacaatttgttgaaaaggaggtaaataaaatacttaagacatctaataagtgggggtaaaagaaaactcagcccagaaagaatagaggggatcataggcctgtctctaccaactaccaaacacaaacttagaaaattcctaggcctaattggatattgttgcctttggattgattcttatgcattaaaaactaaaaatctatattctaagcttgtggaggaaggccctgaccccctactgtggagccaggaggaaatacaacaattcagggatctgagggaggtgctgacgggtgcccctgttctggctctaccaccccttgaaaaacctcatacaggaacatgggggaagtcgccagccagtggcctttctttcccacttcctgaaccctgtcaccagaggatggcctgagtgcatacagtcggtagccgccattgccctcttaactgaagagagcaggaaactcacctttggaggaaggctaaccgtgagtaccccacaccaggtaggagccatcctaaaccaaagggtagggagatggctcactgactcccgaattttaaaatatgaggcaatcttattggaaagggatgacttaactttaaccactgatgaggccttaaaccctgcttctttcctcactcaaagggagccctgaactcccatagaacatcattgtttaaatttaataagactatcagaccaaaacttgacccaatctgtgggaaactcccttccgttcagggagacatttattcattgatggatcttctggggtcatccagggaaaatgacacaatggttactcagtcattgatggagagactcaatcaataactgagtcaggaagactcccaaatgcatggtcggctcaaacttgagaactctctgcccttaaccaagccttaaaatatttacaaagaaaggagggcacaatctatactgactctaaatatgtctttggagtggtccatacctttggaaaaatttggatggaaaggggacttattaacaataaaggacagggactaatacatgaagaattaattaaacaagtacttaataatctccaactcccagaagagatagcagtggtatatgtgccaggacaccagaagggggcctcatttgaaccctggggaaattccttagcagatgaggaagccaagagagtggcattagaataggaggttcctatcttccatctactccctcccttcccaaaataatgatctctccctccttttcagaaagaggaggaacagctacaacagctgggggcccaacctgacactcagggaagatggttcctcccagacgagagggaaatgctatccaaacccattatgagagaaattctgacacacctacaccaacggagccattgggggcctcaggccatgtgtgacacagtcttaagggtctatgggtgtgttggtatttacacaatgaccaaacaggtaatagaaggttgcttaacatgcaaaaagaccaataaaaggaatttatgaaaaacagctactggaggaaggtgtcctggtttaagccctttccagagtatccaaattgattacacctaaatgcccaaagtagggcgacttaaatacctcttagtcatagtagaccatctaacccattgggtagaggccaccccattacccagtgccactaccaattatgtgacaaaggccctattagagcaaattattccccaatttgggatggttgaaaacatagattcagatgatggaagtcattgtacagctcagataataaagggactctccagagaattagatattaaatgggaataccacacccatggcatcctccctcttctggtcgaattgagagaaggaaccaaactctaaaagctcacttaactaaattaatactagaaacctggctaccctggaccaaatgtctccctattgctttacttagaattagaactgctctctgaaaagatgtcagtctatctccatatgaaatgttatatggacttccttacctgagtagatcatctgacctgcctacctttgaaaccaaagatcaattttttaaaatatctttttatttttcccactgtacagcatggggaccaggttatacatacatgtatatactttttcctcccattcttgtgttgcgatgtaagtatctagacatagttctcaatgctacacggcaggatctcattgtaaatccattccaagagcaataggaagcctctgttaaccccaagctcccagtccatcccactccctccctctcccccccggcagccacaagtctattctccaagtccctgattttcttttctgtggaaaagttcacttgtgctgtatattagattccagttataagtgatatcatatggtatttgtctttctctttcttatttcactcagtatgagagtctctagttccatccatgttgctgcaaatggcattattttgttctttttatggctgagtagtattccattgtgtatatataccacatcttcataatccaatcacctgtcagtggacatttgggttgtttccatgtcctggctattgtgaataatgctgcaatgaatatgcagtgcatgtgtctttttttttttttttttgtctttttgccatttcttgggctgctcctgtggcatatggagtttcccaagctaggggttgaatcggagctatagccatcagcctacaccagagccacagcaacgtggaatccgagccgtgtctgcaacctacaccacagctcacggcaacaccggatcttttaacccactgagcaaggacagggatcaaacccacaacctcatggttcctagttggattcgttaaccactgcgccacgacgggaactctgcatgtgtcttttttaagtaaagttttgtctggatatatgtccaagagtgggattgctgggtcatatggcaattgtatgtataggtttctaaggtacctccatactggtctccatagtggctgtaccagcttacattcacaccaacaatgcaagagagttcccttttctccacaacccctccagcatttgttatttgtggacttattaatgatggccattctgactagtgtgatttgcatttctctaataatcaggtatgttgagcattttttcatgtgctcgttggccatctgtacatcttccttggagaacagtctattcaggtcttttgtccgtttttccattgggttgttggcttttttgctgttgagttgcataagttgcttgtgtactatagagattaagcccttgtcagttgcatcatttgaaactattttctcccattctgtaagttgtctttttgttttctttttgatttcctttgctgtgcaaaagcttgtcagtttgattaggtcccattggcttatttttgcttttatttctgttgctttgggagactgacctgagaaaatattcatgaggttgatgtcagaaaatgttttgcttatgttctcttccaggagtttgatggtgtcttgtcttatatttaagtctttcagccattttgagtttattttcttgcatggtgtgagggtgtgttctaatttcattgatttgcatgtagctgtccagatttcccagcaccacttgctgaagagactgtctttttccattttatgttcttgcctgctttgtcaaagattaattgaccataggtggctgggtttatttctgggttctctattggtcggtctgtctgttttggtaccagtaccacactgtcttgatgactgtggctttgtaatattgcctgaagtgtgggagagttatgcctcctgcttggtttttgtttctcaggattgctttggtgattctgggtcttttgtggttccacataaatttttggattgtttgttctagttctgtgaaaaatgtcataagtaagttgatagggattgtattgaatctgaagattgctttgggtagtatggccatgtttacaatattgattttcccaatccaggaacatggaatatctttccgtttctttatgtcttctttaatttccttgattaatgttttatagttctcggtgtataagtcctttacctccttggtcaggtatattcccaggtatttgattttttgaggtgcaattttaaaaggtattgtatttttgtattacttttctaatattttgttgttagtatacagaaatgcgactgatttctgagtgttaatcttatatcctgctactttgctgaatttgttaatcagttcaagtagttttggggttgagtccttagggttttctatgtatagtatcatgtcatctgcatacagtgacagttttatctcttctcttcctatttggatgccttttatttctttggtttgtctaattgctgtggctaggatttccaaaactatgttgaatagcagtggtgagagtgggcatccctgtcttgttccagatttgagtgagaaggctttcaatttttccccattgagtattatatttgctgtgggtttgtcataagtggctttgattatgttcagaaatattccctctatacccactttggcgagagtttttatcataaatggatgttggacttttttaaatgctttttctgcatctattaagatgatcatatggtttttgacttttcttttgttaatgtggtgtatgacgttgattgatgtgtgtatgttgaaccatctttgtgaacctgggatgaaccccacctggtcatgctgtacgatctttttgatatgttgttggatttggttggctaaaatttttgttgagaatttttgcatctatattcatcaaagatattggccgatatcttttcctttttggtggtatctttgcctggttttggaattagggtgatggtggtgttgtagaatgcctttgggagtgttccttcttcctcaaccttttgaaaaaatttaaggaggatgggcaccaggtcctttttgtatgtttggtagaatttgcctgtgaagccatctggtcctgggcttttatttgtagggagtgtttttatgatgtgttcaatttcatttctagtgactggtctgttcagttggtctgtttcttcttgattcagttttggcaggctataagattctagaaagttgtccatttctccatagcatatagaggttcccaggctaggggtcgaatcagagctgtagccaccggcctacacccagagccacagcaacgcgggatccgagccacatctgca

SEQ ID NO: 41 - DNA, 11755 bp, Artificial
  ss51 sequence
aaactgcctcgagaaaaggagccacctatttttcaagaagaggccaagaacttgctgccccatgcctctcatctctatgtgctaccagcccctcctttgggggccaaaggtccccaattgccagacaccccactcccctctttctcctcctcctcttcctgaagtccccaaggcgatatcacccctgcatcgatatcactcccgcaaccagattcactggaaccggtgagcaggcatctctggtcagccctgggagcagctgccccagcgctacaaatgcccttacagaagacatgggaacctcaacataccaccacagatgggaccatacaagagggaaaaccagtcttttactaccagcccttttccacggcaggccctcctacaggggtaaaggcggaggctaaaaagcctactgacatggccaagaccactgagatgctgcaaaagccggatgaaagcccagccaacttctatgagaaactaggtgaggcttttcagatcttcactccttttgatcctgaagcccctgagaaccaaccaaatgctgcctttgtgggacaggcccaatcagacatctgtaaaaagctacagaaaattgaaggatttgcaggaaaaaatgccacaaaattactagaaatagccaacaaagtttttgctaaccctctgcaatgcagaaaagagcctgaaacaaaaagctgcgctcctggcggccctgtcgaaacccgtacctccggcaggactaccctgtaagtcaaggggcccaaggccaggaaaaaggagcccccttggacacgatcagtgtgcctactgtaaagacactggaaaaatgaatgtcccaaccgtcctgagaaaaggaccaaagcggcacccccacctagccgttactaacctgagccatccagcacgaatatgataggcttagccaaagccgaatccgactggggggaccaggctctctccaactaggtccccaagagcctatggtcagaattcaagttgggggctgtcccgtagactttatggtagatacaggtgctgaacattcggtgttcacgcaaactgtgactcctctctcaggaagagaaactaccatcacaggtgcccaaatctgcaggcctttctgcagtccccaatggtgccggttaggaggccatgaggtagtacatgaatttctttacctgccagactacccagctccctcgacgagaaaagacctgctggccaagatgggggctcaaatctctttctctgcagacaatcagctcaactcaaattaacagacccgccctcttctttaatcatgtctctcactgtaaggagggaagaaaaatggtgccggtactcttcccctccagaagaggggagcgttcccctggaactagagactgagtacacattggtttgggccaatggaaaccctctgggactagcaagatgccatgctcctatcttgattgatctgaaacctggagctcaactggtaaagctgcagcagtactcgattcccagagaagctcaactgggaatccaggctcacctgcaccggctacttgagcacggacttttgataaagtgtcagtcgccctgcaacacccccttattgcctgtaaagaaaccagggacacaagcctactgcccagttcaggacctgagggccataaatgaggcagcaatcatgctgcacccatccgtgcctaacccgtatatcctgctggggctaatcccttccactgccaagtggttcacttgcctggacttaaaagatgccttcttctgcctccgagtggcacctgctagtcagcccttgtttgcctttgaatgggaaaacccacacactgggacaaaggagcagctcatttggacaagactcccacaaggattcaagaactctcctactcttttcagtggtgccacggccactgacctggctgaatttcctggacaaaaactagactgtgtcttgctgcagtacattgatggcctcttgctggccagcaccacgaaggctcaatgcctagggggaaccaaagcccttgtctccctgctaatggaagctgggtattgggtatctaggaaaaaggcacaaatctgtaagaaacaagtcaggtatctgggatttaacttcatgcagggccgacaaatgttaggtactgaaagtttgtgccattctggtccctaccacccactggaaggttggtgagttcttaggggcatcaggattctgggcagcagggtatggatccctgggttttcagacttggccagacctccatatgaggccctgaaaggaagagaaaaggctccccttgaatagggaccgaaccaggaggcagcatttcagacaatcgagacgaaactcactgaggctctggccttaggacttcctgatgtaaccaaagaattcaatctctttgttcatgagaaaaatggaatagccttgggagtcctaacccaagaatttggaccttgacagaggccggtggcctatttgtctaagcaaattgactcagttgtggccggatggcttccctgcctctgagcactggcagctaccaccttgttaagggaggatgacaagttgactctgggaaagaaccttaatgttaaagtcccacattcagttgtaaccctgatggacaatcagggccatcactggctcacgcatgcacgaatgactcaataccaagggtcactatgtgaaaatctatgggtaaagctggaagttgtatgaaccctaaacccagccaccttcctaccagatgaagtggggcccccagaccataacttcttagaggtactagatgaagtgttttccagtaggcctgacttaactgacagaccactccaaaatccagaactggttctaaatactgatggcagcagcttcttaaaggatacaaaaaggatggcaggatatgctgtggtatctgattcggaagtgatggaagtagatgtgcttcctcaaggttggtcagctcagagaacagaattatgggcattaatcaaagtactggagcttagccaagaccagcgagttaatacctataccaactcacagtatgcctttgcaacttcacacgtccacggagccttatataagaagaggggactcctcactgctgaaggaaaagggatcaaaaaccaggctgaaatcttaaatctcctaaaagcagtatgggagccttaagaggtggcagttatctactgcaaaggccaccaaaagggaggcgacccagtggcaaaaggaaatcgcagtgttgatgcagccgccagacgagtagcctggggacaaccaccagacaaacccaaggtcctgctggccccagaagtgccacctgtccccaagtactctctagaggaagaaaggtggataaaagaggaaggaggaatcaaaacaaagatgggatgtggatcacacaggaccgctgggtttatgttccaaacagctggcctacaaattagtctaccaacaacacgagctaacccacatgggcaaaactgccttagagaccttactggtgggtactacctcattgcacgtcttcccgcactctcctcctccatctcccaatggtgcataacttatttgaaaaataatgcctgccagggccttagcagggacacaacactgtggactgtccccatctgtggatatggaagtagacttcactgaagtgaccccgagcaagggatacaaatacctgctagtttttgtctgtaccttttcagggtgggtagaagctttcccagcctgaactgagggtcaccagaaaagacaagacaaagggccttttttacatatcttcaactctgtactacagatcaaccacactgaaaagatcttcacttaactatgctaattctctatttttccttttcaaaattctccaacagtctttactggagtttccttgtggsstgccctcgaattccagaccctgttccctataggtaaaagatcatattttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcataagataaaaagaggagaagtcaattgcctaacggaccccagtaagatcgggcgtgccacaaaatgttgaaaatcctgataaatatatcttggtgacaatatgtctcccccacccagagacaggcacaaacatgtaactccagaacaacttaaaattaattggtccacaaagcgcgggctctcgaagttttgaattgactggtttgcgatattttaaaaatgattagtttgtaaaagcgcgggctttgttgtgaaccccataaaagctgtcccgactccacactcggggccgcagtcctctacccctgcgtggcgtacgactgtgggccccagcgcgctcggaataaaaatcctcttgctgtttgcatcaagaccgcttctcgtgagtgatttggggtgtcgcctcttccgagtcaggacgagagggattttaactcgactggcctttcagtttggtgcgttggccgggaaacccgcgactacccctcacacccgagaaccgacttggaggtaaagggatcccctttggaacgtgtgagtgtgtgtgtcggctggcgtctctgttctgagtgtctgttttcggtgatgcgcgctttcggtttgcagctgtcctctcagaccataaggactgggggactgtgatcagcagacgtgctaggaggatcacaggctgccaccctgggggacgccccgggaggtggggagagccagggacgcctggtggtctccttctgtcggtcagaggaccgagttctgttgttgaagcgaaagcttccccctccgcggccgtccgactcttttgcctgcttgtggaagacgcggacgggtcgcgtgtgtctggatctgttggtttctgttttgtgtgtctttgtcttgtgcgtccttgtctacagttttaatatgggacagacggtgacgacccctcttagtttgactctcgaccattggactgaagttaaatccagggctcataatttgtcagttcaggttaagaagggaccttggcagactttctgtgtctctgaatggccgacattcgatgttggatggccatcagaggggacctttaattctgagattatcctggctgttaaagcaattatttttcagactggacccggctctcatcccgatcaggagccctatatccttacgtggcaagatttggcagaggatcctccgccatgggttaaaccttggctgaataagccaagaaagccaggtccccgaattctggctcttggagagaaaaacaaacactcggctaaaaaagtcaagccctctcctcatatctaccccgagattgaggagccgccggcttggccggaaccccaatctgttcccccacccccttatccggcacagggtgctgcgaggggaccctctgcccctcctggagctccggcggtggagggacctgctgcagggactcggagccggaggggcgccaccccggagcggacagacgagatcgcgacattaccgctgcgcacgtacggccctcccataccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaacttggctaaggtaagagaggtgatgcagggaccgaatgaacctccctcagtttttcttgagaggctcatggaagccttcaggcggttcaccccttttgatcctacctcggaggctcagaaagcctcaatggctctggccttcataggacagtcagccctggatatcagaaagaagcttcagagactggaagggttacaggaggctgagttacgtgatctagtgaaggaggcaaaaaaagtgtattacaaaagggagacagaagaagaaagggaacaaagaaaagagagagaaagagaggaaagggaggaaagacgtaataaacggcaagagaagaatttgactaagatcttggctgcagtggttgaagggaaaagcaatagggaaagagagagagattttaggaaaattaggtcaggccctagacagtcagggaacctgggcaataggaccccactcgacaaggaccaatgtgcatattgtaaagaaaaaggacactgggcaagggactgccccaagaagggaaacaaaggactgaaggtcttagctctggaagaagataaagactagggaagacggggttcggaccccctccccgagcccagggtaactttaaaggtggaggggcaaccagttgagtttctggttgataccggagcgaaacattcagtgctactacagccattaggaaaactaaaagataaaaaatcctgggtgatgggtgccacagggcaacaacaatatccatggactacccgaagaacagttgacttgggagtgggacgggtaacccactcgtttctggtcatacctgagtgcccagcacccctcttaggtagagacttactgaccaagatgggagcacaaatttcttttgaacaagggaaaccagaagtgtctgcaaataacaaacctatcactgtgttgaccctccaattagatgacgaatatcgactatattctcccctagtaaagcctgatcaaaatatacaattctggttggaacagtttccccaagcctgggcagaaaccgcagggatgggtttggcaaagcaagttcccccacaggttattcaactgaaagccagtgctgcaccagtgtcagtcagacagtaccccttgagtaaagaagctcgagaagaaattcggccgcatgttcaaagattaatccaacagggcatcctagttcctgtccaatctccctggaatactcccctgctaccggttaaaaagcctgggactaatgactatcgaccagtacaggacttgagagaggtcaataaacgggtgcaggatatacacccaacagtcccgaacccttataacctcttgtgtgctctcccaccccaacggagctggtatacagtattggacttaaaggatgccttcttctgcctgagactacatcccactagccaaccactttttgccttcgaatggagagatccaggtgcgggaagaaccgggcagctcacttggactcgactgccccaagggttcaaaaactccccgaccatctttgacgaagccctacacagagacctggccaacttcaggatccaacacccccaggtgaccctcctccagtacgtggatgacctgcttctggcgggagccaccaaacaggactgcttagaaggtacgaaggcactactgctggaattgtctgacctaggctacagagcctccgctaagaaggcccagatttgcaggagagagataacatacttggggtacagtttgcggggcgggcagcgatggctgacggaggcacggaagagaactgtagtccagataccggccccaaccacagccaaacaagtgagagagtttttggggacagctggattttgcagactgtggatcccggggtttgcgaccttagcagccccactctacccactaaccaaagaaaaaggggaattctcctgggctcctgagcaccagaaggcatttgatgctatcaaaaaggccctgctgagcgcacctgctctggccctccctgacgtgactaaaccctttaccctttatgtggatgagcgtaagggagtagcccggggagttttaacccaaactctaagaccatggaggagacctgttgcctacctgtcaaagaagctcgatcctgtagccagtggttggcccatatgcctgaaggctatcgcagctgtggccatactggtcaaggacgctgacaaattgactttgggacagaatataactgtaatagccccccatgcgttggagaacatcgttcggcagcccccagaccgatggatgaccaacgcccgcatgacccactatcaaagcctgcttctcacagagagggtcacgttcgctccaccagccgctctcaaccctgccactcttctgcctgaagagactgatgaaccagtgactcatgattgccatcaactattgattgaggagactggggtccgcaaggaccttacagacataccgctgactggagaagtgttaacctggttcactgacggaagcagctatgtggtggaagacaccttttcaggatgggtagaggcttatcctactaagaaagagacttcaaccgtggtggctaagaaaatactggaggaaatttttccaagatttggaatacctaaggtaatagggtcagacaatggtccagctttcgttgcccaggtaagtcagggactggccaagatattggggattgattggaaactgcattgtgcatacagaccccaaagctcaggacaggtaaagaggatgaatagaaccattaaagagacccttaccaaattgaccacagagactggcattaatgattggatagctctcctgccctttgtgctttttagggtgaggaacacccctggacagtttgggctgaccccctataaattgctctacgggggacccccccccgttggcagaaattgcctttgcacatagtgctgatgtgctgctttcccagcctttgttctctaggctcaaggcgctcgagtgggtgaggcagcgagcgtggaagcagctccgggaggcctactcaggaggagacttgcaagttccacatcgcttccaagttggagattcagtctatgttagacgccaccgtgcaggaaacctcaagactcggtggaagggaccttatctcgtacttttgaccacaccaacggctgtgaaagtcgaaggaatccccacctggatccatgcatcccacgttaagccggcgccacctcccgattcggggtggaaagccgaaaagactgaaaatccccttaagcttcgcctccatcgcgtggttccttactctgtcaataactcctcaagttaatggtaaacgccttgtggacagcccgaactcccataaacccttatctctcacctggttacttactgactccggtacaggtattaatattaacagcactcaaggggaggctcccttggggacctggtggcctgaattatatgtctgccttcgatcagtaatccctggtctcaatgaccaggccacaccccccgatgtactccgtgcttacgggttttacgtttgcccaggacccccaaataatgaagaatattgtggaaatcctcaggatttcttttgcaagcaatggagctgcgtaacttctaatgatgggaattggaaatggccagtctctcagcaagacagagtaagttactcttttgttaacaatcctaccagttataatcaatttaattatggccatgggagatggaaagattggcaacagcgggtacaaaaagatgtacgaaataagcaaataagctgtcattcgttagacctagattacttaaaaataagtttcactgaaaaaggaaaacaagaaaatattcaaaagtgggtaaatggtatgtcttggggaatagtgtactatggaggctctgggagaaagaaaggatctgttctgactattcgcctcagaatagaaactcagatggaacctccggttgctataggaccaaataagggtttggccgaacaaggacctccaatccaagaacagaggccatctcctaacccctctgattacaatacaacctctggatcagtccccactgagcctaacatcactattaaaacaggggcgaaactttttaacctcatccagggagcttttcaagctcttaactccacgactccagaggctacctcttcttgttggctttgcttagcttcgggcccaccttactatgagggaatggctagaggagggaaattcaatgtgacaaaggaacatagagaccaatgtacatggggatcccaaaataagcttacccttactgaggtttctggaaaaggcacctgcatagggatggttcccccatcccaccaacacctttgtaaccacactaaagcctttaatcgaacctctgagagtcagtatctggtacctggttatgacaggtggtgggcatgtaatactggattaaccccttgtgtttccaccttggttttcaaccaaactaaagacttttgcgttatggtccaaattgtcccccgggtgtactactatcccgaaaaagcagtccttgatgaatatgactatagatataatcggccaaaaagagagcccatatccctgacactagctgtaatgctcggattgggagtggctgcaggcgtgggaacaggaacggctgccctaatcacaggaccgcaacagctggagaaaggacttagtaacctacatcgaattgtaacggaagatctccaagccctagaaaaatctgtcagtaacctagaggaatccctaacctccttatctgaagtggttctacagaacagaagggggttagatctgttatttctaaaagaaggagggttatgtgtagccttaaaagaggaatgctgcttttatgtggatcattcaggagctatcagggactccatgagcaagctcagagaaaggttagaaaaacgtcacaaagaaaaagaggctggccaaggatggtttgagggatggttcaacaagtccccatgggtgaccaccctgctttctgctctaacaggacccctagtaatactgctcctgttgcttacagttgggccttgcttaattaatcggtttgttgcctttgttagagaacaagtgagtgcagttcggatcatggtacttagacagcagtaccaaggccttccaagctaaggagaaactgacctttagccttcctagttctaagattagaactattaacaagagaagaagtggggaatgaaaggatgaaaatgcaacctgactctcccagaacccaggaagttaataagaagctctaaatgccctcgaattccagaccctgttccctataggtaaaagatcatactttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcataagataaaaagaggagaagtcaattgcctaacggaccccagtaagatcgggcgtgccacaaaatgttgaaaatcctgataaatatatcttggtgacaatatgtctcccccacccagagacaggcacaaacatgtaactccagaacaacttaaaattaattggtccacaaagcgcgggctctcgaagttttgaattgactggtttgcgatattttaaaaatgattagtttgtaaaagcgcgggctttgttgtgaacccca

SEQ ID NO: 42 - DNA, 8726 bp, Artificial
  ss65 sequence
tggctgtgaaataagagttctgactaaggaaaacccccccgatccttggctaaaaaggcagctgcaagccttttcagctgtgctcacctcataccacccttcttgtaataatgtagcaacaatgtaccctatgcccaagccagcagccctgctaatcatgttcccagcattgcttatcagttccgcttctgtaaccttgcttgctcagtttcttagggaggaacactgtctgctctgggaaagggggaggtccgggatgcttccatgggaaaatcatgaccttgcaatgtataaaattgctgagaacacagacttggtgctcagactgtggaagtgactcctctgagccagcactggtgtgaaataaaccttccttttccacatttccgagtttgtctccttccactgccatggtttttgcttcttctgcaacattttggtgtgttggctgtgaagccaacaaccaagctggcctcttgtgtgccactgttgttggggaaccaggggaggtcatggtcaccagtccagtgacaggtggatagcactcactggccagatccagaccctcacctgggccatgatggccttggctcacactgcttcccaaagggactcaggagagtggaaacaggttccaggacaggatgttggactggtgagtgccccggggacatctgcccaagtaggacccaccttacagcagaaggagagactgatcacctctcagtgaccaaagggttactcaggtcaggatttgttcccttgggatcggaagacttgtcaattctggggtgtgtgcatgtgtgtggccctcttcagagggatcctgacgttggggtttacacagtcaaaccaaagctaagaggcgcctgaaatatctcctccagggtagaggtcaggcagacaaggcgactgttacctgaggccttgtcctcgctgtttgtcttgcgtcgccgtcacaaggtgggacttcacacagtgggtaaattggcttccaagcccactgtcttagagtgtatggttaagaattttaagaaaggattttcaagagattatggtgttaaactgagtcctggaaaactgggtaccctctgtaccctagaatggcccacctttggtgttggatggcccccagaagggatcttagatgtgttcatggttggagcagtatataatgttataacaggagaccctggacacccataccaatttccatatattgatcaatggttggaaattgcccatttgaggcccccatggattcggttctgtgccacaggccaggaacagtgtaaggtgctagtgttccattccaagaagaaaaccttgtctcaagaaaaggtgccacatatttttcaaggggaaactgaggcctcgccctctatgccacctccctatgtgctgtcagccccacctctgcgagccgaaggtccccagatgcagatagcccaccttctgttcctcctactcctgctcctgaagttcctgaggcaatatcacccccacagccagattcaccagaaccaatgagcaggtgtctccagtcagcccagagagctgccactccagcattgcaaatgccctacaggagacatggggaccaaggcaaatcacccctgatgggaccatagaagagaggggatggtttttttgttaccatcccttttccactgctgatctccttaactggaaacaccatactcattcgtattctgaaaagcctcaggcactgattgaaatctcatagaattcattttccagacacactgttccacctggatagactgccggcaactcctttttactctgacactgaagagcactggtgaattataacagaagcccataaatgccttgaggccaatgcagggggtcgagcagaattggaaaactgggtaagggaagccttcccagaagaaaacccccactgggactatgacactgaagaagggaaatgtaacttagagaggtactggcaggccttcctacagggggcaaaagctggggataaaaggcctactagtatagctaagaccagcgagctactacaggagctgaatgaaagcccagccaaattctatgagagattatgtgaggcttttcaaatctacaccccttttgatccccaggcccccaaaaaccaatggatgataaatgctgcctttgtgggacaatcccaatcagatatccataaaaactacagaagttagaaggttttgcaggaaagaatgccactgaactgttggaaatagcaaacaaagtttttattaactgagaccaggtggcccaccacaatgcagaaaagagaataaagcaaaaagtgacacttctggcagcctccctgtcaaagctggtgcccccagtgggactaccccatagggcacaagacccaaggccaggcaaaatgagccccctggaacatgatcaatgtgcttactgcaaagagaagggacatcggaaaaaatgaatgccccaactgtcctgagaaaagacataaggctccacctagccggtaccgatctgagccattcagcaccaacctgatcggcctagccaagtctgattagggggcaccaggctctctccaactgggcccccgagggcctatggtcagaattcaagtagggggccactccatagactttatggtagatacaggtgctgagctttcagtggtcacgcaacctgtagctctcctctcagggaaagaaaccaccatcattggggccacaggtgaccaaacccacaggcccttctgtagtccccagcaatgctgattagggggccatgaagtaacacatgaatttctttacctgcctgactgctcagtccccttgatgggaagagacctgctgggtaaaatgggggcacaaatttccttttccactgatggatcggcccaattggcccaactcaaattaacagaatccccctctcctttagtcatggctctcactgtaagaagggaagaggaatggcgcttgcactcttccccttcagaaatggggaccattcccccaaaactagagactaaatacctgttggtttgggctaaaggggacctaccaggactggcaaaatgattgatctaaaacctggacctcaaccagtaaagctatggcaatactcaattttcagagatgcttgactgggaattcaggttcatctggataggctgcttcagcacagactgttaataaaacgtcagtcccccagaacacccctttgctgcccataagaaaaccaggaacacaagactaccgcccagttcaagactttacagccataaatgaaggaacagtcacattgcacctgtccgtccctaacccgtatatactgctagagctgatcccctgcactgctgagtggtttacttgctgggacttaaaagatgcctttttcggcctccaggtggcgcctgccagtcagcctttgtttgcctttgaatgagaaaatccacatacagggacaaaggaactgctcacttggatgagactcccacaaggattttaaaaactcccctactctttttagtggcgccctggccgctgagctagctgaatttcctggacaaaaactgggctgtgttttgctacagtacattgatgatgtcttgctagctagccccacgcaggctcagagcctagagggatcaagagctctcctttccctactaatggaggcagggtattgggtatcaaagaaaaaggcacaaatctgtaagaagcaagtcaagtatcttggctttaacatcatgcagggccgacgaatgctggggactgaaagaaaacaggcagtttgtgccattactgtccctaccacctgctggaaggtttgtgagttcctaggggcagcaggattctgctggatatggatccctgggttttcagacttggccaggcctctatatgaggctctaaaaggggaagaaaaagctccccttgaatggggaccaagccagaaggaagcatttcagacaatcaaaaccaaattcactgaggctccagctttacgacttcctgatgtaaccagagaatttaacctctttgttcatgagaaaaatgggatggttctgggagtcctaacccaagagttcaggccttggcagaggccggcagcatatctgtctaaacaaattgactcagttgtggctggatggcctccctgcctctgagtgctggcagctaccaccgttttaatgagaaaagctgacaaattgactctgggacaaaacctcaatgttaaagtcctgcactcagctataatcttaatggatgctaggggccaccactggctcacacatgcacaaatgactcagtatcaagggttactgtgtgaaaatccatgggtaaaaatggaggttgtacaaactctgaacccagccacttttctgccagatgaagcggggcccccagactataactgcttagaggtactagatgaggtgttttccagcaggcctgacttgactgataaaccactccaaaattctgacctggttttatatactgatggcagcagttttatggaagttggaaaaaggatggtgggttatgctgtggtatctgacttagaagtgatagaagcagaggtgcttcctcaagactggtcagcccagagagcagaattatgggccttaatcagaacactggagctcagctgagaccaggagttaatactgactcatggaatgcctttgcaactttacatgtccatggagccttatataaggaaagaggactcctcactactgaaggaaaagggattaaaaaccaggctgaaatcttaaagctcctagaggcagtgtggatgcctaaagaatttgcagttatccaccgtaaaggccaccaaaagggagacgacccagtgacaaaaggaaaccatagtgctgatgcagctgccggacaagcagcccggggacaacagccagacaaacctaaggtcttgctggccccagaagtgccagctatctccagatattctccaaaggaagaaaaatgggtaaggaaggaaggcagaaccaaaactaagatgagatggtgggtcacacaggaccaccacatttatgttccagaatagctatcctacaaactagtccaccaacaacatgagctaacccacatgggcaaaactgccttagagaccttactgggccagtactatctcattgcacatctttccacactctgctcctctgtctcccaaagatgcatcacctgtttgcagagtaatgctcaccaggggtccagcagaccagctgggacacaagactctggactgtctccatttaaggatatggaagtggactttactgaagtcactccaagcaaggggtacaaatacttactagtttgtatctgtactttttcaggatgggtagaagccttccctacccaaactgaaaaggcaaaggaagtaaccaaggcactcctaagagacattattcccagatacagaatgcttctgaccatcaggtcagataatggaccagcatttgtggctgagacagtacaacaggtagcaaaagccttacagatctgatggaaattacattctgcttatcaccctcagttcagggaaagtagaatgcatgaactggacccttaaacagacactagcaaagttatgtcaggaaactggcttgccctggggagacatgttgccagtggccctcctaaaagtgagatgctcacccggtgtgggaacagggttcttgccatttgaaatcttatgtgggaggccacttccactgatcaatttaagaggaaacaccagggagttgggagacttggcattacataaacaattacaaggactggggctcactatctgtcagatacataaatgggtcactgataggattcccgtgtccttaggcgggacagtacacccccacaagccagggcaccaggtggggagaaaggactgaaaaaaggattctttgaggctggtatgaaaggccccctatattgtaattctgaccacccctactgctctcaaaagcaacaggaatagatgctgggatccaccatcccagagttaaaccagctggcccagctgacaaccgtggagagtgggagactgccctcaatccagagaaacctctacacctgaaaatatagaggaggagacactgatctcatagccctgctctgaccacacgagaagctggtcagtcaacgcatggctgaagcttgaggaattggctgcccagtaaaataaactgccttctcatccacaagagactttcttactgttatatactgttatctcatatccaacatgtttatttgctgcctgtgctgttaatctgtacccccttggccctgccaggatccatttcctcacgtgacccatgcatttgagtgacccaatcagatcaaggggttacatggactttgctttactctgctcatttctccaaattcaaggaagttgtactcacaacaggaccacttattctgtcagcagggggaccaatatacctgctttgatccacaatactcaccgaggaatggttagaggtccatcgctcttataaatcagggcaactaattaatcagatccaaattatcaccccctagttgccagtatcaatactttttgatgcctgtgaagctatgaatgggccattgacttctactagaccatgtgaaagtccatcataggaaagagaatataggctccaggataaatatatgtgctgggggaccacctggagtggttgccacaaatgcacattttggagctgtgtaaccttggaaacctgggataagggagacagaacagctgtccttcaaaaaggtacagcccatccagactgtcagactaaaacttgtaacccagttaatttcactattctcaattcccatgatcccaaatggaaggagggtttcaaaataagcattcacattaatggaagaggcctggatcctggagctctactacatttccagagaatcacgcttatgctccaagctgcctctcacagggtctttcattccttttatgaagagataaagaataccccacctccaattctggccacaactaagaatttgttcttagccctggcagaaactattgcacaaactctcaaggtctcctcttgttatgtatgtgggggaacgaacacaggagaccactggccttggcaagccagggaactgaacccattagaacctcataatgagactgcataaccccaactcaccagtggggtatgactcctcagaactgctattatagggagaaactgtcttgcgaggcagggaggatggttcagtgtctcagttggaagcctaacatgtttaggcctggggatttataacctgactgcccaaaaaactcaatggtggtcatcctgcaacctctcagagcccaagcctaatcccctgtataacttttcccacctctgacagacatgggaggatatcagtgctaatatccaatggtgggcaccaaagagattatactggatttgtggaaaaatggcatattccataatcccccccaactgggccaggggatgtgtactgggaacaatcagaccatccttcttcctgctcccactgtcactaggggagcaactgggagttcctatatgtagggcacagggcacccagagagattgaagagctctccagattggagaatggaaagatgatgaatgccacccccccccagaatggataattcaatattatgggccagccacccaggcagaggatggtacttggggatattgcccccccatctatatgctgaactgcatcatcagactacaggtggtttttggaacttataacaaatgacattgtaagggctgtgactatattggccccacaccaaaccaaaatgcacaattccatctaccaaaactactggccctgggattattactgtttttctaaaggaggggtttgtggaaaatttactttagtaattgttgcttacaaatacatgacaccagaaaagtgatagaagaaattgctgactgcatgactaaacttgcccgtgtgcctgtacaaacttggaagggataagatgtggacagtctctttggtaaatggttctcttggttgggaggaattaagacaatggttggaataatcatggtcatacttgtggggtgtctacttattccctgccttatattataaaaggttttataaaaaccatggttgagagaaaaacagcctcccacctgctacttatcagaggttaccaatgggtaataactgatgatgatctctgaagggtgcagatacaccctgaacatcaagaggtggggaatgaaataagagttttaattaagggacaaccccccgacccttggctaaaaaggcagctgcaagccttttcagctatgctcacctcataccacccttcttttaataatgtagcaacaatgtaccctatgcccaagccagcagccctgctaatcatgttcccagcattgcttatcagttccgcttctgtaaccttgcttgctcagtttcttagggaggaacactgtctgctctgggaaaaggggaggtccaggatgcttccatgggaaaatcaagacattgtaatgtataaaagttgctgagaacacagacttggtgctcagactgtggaggtgactcctctgaacccgcaccagtgctgaataaaccttgcttttccatagctccgagtgctgtttgtctccttccactgccatggtttttgcggtttctgca

SEQ ID NO: 43 - DNA, 14030 bp, Artificial
  ss116 sequence
tgggggctcatccaggattctgggtccactggactatggactcttgaggaggggaggcatgtcccatggccctgttgtggtggccctgaattgagaagtctgtgcctgtgaacttaaaacccatggagagttctcgacaatgtgggaaatcacatgacaacaaggcaacttcctttaacaaaccaaggtaagaaagatcatagggacgatcaagtatctccttggtggttagggaagaaggttgataagcctcaaagggtctcaggtgagaccagtggtctcaggtgagaccggtgatttaaggtgaaatcagaggatcagaacatgattctgggagatgggaagtaagtcttcccaacctgtacctccacttggaggattgaattgtgggaggtaccaaattccattagatagtactctgggattaatgttaaagtattggggtgacaatccatggatgaaggacaaaaagaacagaaaaatgattaagcattgctgttttatcttgacacagacacctgttcttgccccatccatcttctggccagagtttgggttggacaaggattgggtctgtcagctgcttattcagattgtccagaagaagacatcagcatctcagaaggaaacattatgccctctgttggtggcagggactggtggtctcatttcccctcagagcacaggataagaagggaaaagaggaggaaacccaagagcattctgggacctccttccctccatgggacccccttggcttactgctgccaccttaaaatccccaaaatggctctggctcccctccagccacagctgccaccactgtcactgccaggggagcataacagggggaggggtgcagaggccactgcccaggcacaagggcacttcctctggtcatggagttaacacaggagggggaggggcacagagcccatcatgtaggcgcaagtgcactgcccacactagcagagccagagtaggaaggggaggggcctagagcccaccgtgcaggcgcaagtgcactgccactgttcacagaagcagaacaggaggggggtgccacagacacaggcatactgctgtggcccacgggatcaaagcccactgcctcaacaaaaccagaggacatggcagggccttatcccagacttaagagagagttaaaacaatgtcaggaggatattcaaacttttcctttacctgctgctacctctggggatagacaagaagggccacaaatgctcttcccagtatgggaggttccattaggtgggggaggaatagaatatgtaagtgcccctttaaccagcactgaggtctgaaattttaggagagaattgcaaccattgctgggagacccatatggggtagcggatcaactagatcaactccttgaaccacaagtctatacatagtctgaattaatgtctattttgagcattctgttctctggggaagaaagggggatgattcaaagggaagccatggcctcatgagagcaaacccacactccccagctgggggaagtcagggcagaaacaaaatttccaaatgaggaccccagatgggacaataacaatgcagtccaccaggggcatataatggacttgataaatctaataattcagggaattagaaatctaataatacctcagactcaaaatatatctaaggcatttaaagtatggcaaagtaaagaggagggaccaactaaatttttggaaagacagaattcagatgagaagatatgatggaataaattccactgaccctctgggacagagcatgctcaaatttcactttgtaactaatagttggccagatagaggattggaaaaataaaccattagaggatctattaaaagagacacaaaagttttatgtgagaaggaatgaggaaaagcaaaaacaaaggactaaggtcatgttttcatatcaacaaaaacaagacagatcagatccaaggggtcctaaggacaaaagtaagagagggtcacaagatcagcctcactgatacccagaaacagggcataagggaaagaggaattgatggcaaggtgaaaacaagtgctttaggtgtggcaaattgggacttttcaagagggaatgccctgaatgaaaaaaggagtaaataattcctctcatgttattcaaggaggatgaggattaggggggtcaggggctcttaatagttattgaccaacttaaaaatccataggcgccctacccagagcccttgataaatttagaggtagggccataccatgaaactatgatttttcttattgattcagtggtgtctcactcctcactttgttatttgcccaaagaggtttctccttctcatgaacagatactagtatcaggagtgaaaagggagggattttcagaaaaattttaaaacaaaccaaagtaaattcccaaaatagatgtgccaaaacatgcttattttttgttccagaggctggcacaaatctgtgcagaagagacctaatggccaaattgggactgggtttacaggttaccaaaaaaaaaaaaaaaaacaaaacaaaacaaaaaaaatctttacaaataaaattgaatcttttaaccccaacagtggagggacaaattcaaccacaagtttgggcatcagagggaaatcatgggggacttaaagtgaccccaattaaaatacagttaaagatccctagagaagtagtctggagaaaaaaatatcctatccctctacaaggaaggatgggacttaaaccaattatagaaggactacttcaagagggtctcttagaaccctgtatgtattcctataacacccttattctccctgtgtataagatggatgggtcctatcacttagtccaggatttgcgggcagttaaccagattgctaagactaaacatccagtgtcccaaacccttataccccccctgagtaaaattctatttgaccaccaatagttcagtgtaattgacttaaaggatgccttttgggcatgacccctggacttgaacagtggggacctatttgccttcaaatgggaggacccagtaactggaagaagacaacaatatagatggacagtcctcccccaggggtttgcagactccccacatctttttgggaaaattttagaacaggtgttgggagactttacaccccctcatgggacctgtttactccagtatgtagatgacttgttactctcaaacactgatcaaaagaaacttacagcagttacagtttcccttctcaattttcttggggaaaaaggcctgagggtctccaagaagatgttacaaattgttgaaaaggaggtaaaatatttaggacatctaataagtgggggtaaaagaaaacagcccagaaagaataaaggggatcataggcctgcctctaccaactaccaaacacaaacttagaaagtttctgggcctgattggatattgtcacctttgggtcaattcttatgcattaaaaactaaaaatgtgtattctaaccttatggaggaaggccctgatctctgactatggagccaggaggaaataaaacaattcagggatctgagggaggcactgacggatgccctgggatctggctctaccatctctgaaaaaccttttcatttatttctaagtattgacgggaaaggctctaggggttctcacacaggaacatcggagaagttgccagctagtggcctttctttccctcctccttgaccatgtcaccagaggatggcctgagtacatacagtcagtagctgccaccaccctcttaactgaagggagcaggaaagttacctttggaggcaggctaaccatgagtaccccacaccaggaacaagccatcctaaaccaaatggtagggagatggctcactgacttccaaattttaaatgagacaatcttattggaaagggatgaattaactttaatgactgatgaggacttaaaccctgcttttttcctcactcaaagggagccctcaactcccattgaacatcattgtttaaatttaatagactattagaccaaaacttgacccaatctttggtaggctcccttccattcagagaggcatttattcattgatggatcgtctcaggtcatccagggaaaatgacacaatggttactcagtcattgatggagagactcaatcaataattgagtcaggaagactcccaaattaatggtcggctcaaacttgtgaactctttgcccttaaccaatctgtaaaatattttttaaaaaaggaggacacaatctatactaactctaaatatgactttggagtggtccatacctttgaaaaaattttgatggagaagggacttattgacagtaaaggacagggactaatacatgaagaattaattaaacaagtacttaataatctccaacttccagaagaaatagcagtgatatatgtgccaggtcaccagaagggagactcatttgaagcccaaggaaattccttggcagatgaggaagccaagaaggtggcattagtgttggaggttcctatcttccactttactccctcccttcccaaaataatgatctctcccttcttttcagaaaaagagaaggaacagctacatcagctgggggcccaatctgatgctcagggaagatggttcctccccgacaggagagaaatgctatccaaaccccttattagggaaagtatgacatacctataccaaggaagccactgggggcctcaagccatgtatgacacagtcttaagggtctatgggtgtgccagtatttacacaacagccaaacaggtaatagaaggttacttaacatgcaaaaagaccaataaaaggactttatgaaaaacagctactggaggaaggtctcctggtttaaggcctttccagagtatccaaattgatcacattgaaatgcccaaagtagagtgacttaaatatctcttagtcatagtagaccatctaactcattgggtggaggccactccattacccggtgccactgcaaattatgtgacaaaggccctattagagcaaattattcccagatttggataatggaattcattttacagctcagataatgaagggactctccaaagaattagatattaaatgggaataccataccctgtggcatcctccctcttctggtcaaattgaaagaatgaactaaactctcaaaactcacttaactagattaatactagaaactcggctaccctggaccaaatgtctccctattgctttactcagaattagaactgcttcccaaaaggatgtcagtctatctccatatgaaatgttatatggacttacttacctgtgtagatcatctgacctgcctacttttgaaaccaaagatcaatttttaaggagttatgtatttggtttatccacttctcttcatcttcttagacagaagggattactagcccaggttccacctcttgatttcccaggccattcacatcagcctggagactatgtgttaatcaaatcatggaaagaagacaaacttcagccaacctgggagggacctttccttatgttgctgaccactgaaactgcaattcgaacagccaagcgaggatggactcaccacacccgggtgaaaaaagggggggccataatagataaagaaaaatgggtggcttctctagggaccactgaaacctggttggtcttaaaaagggcttaaaattatccctgatatgggtgactatttggggatcattagtatttggtagtcagggtgaatcatgggaccctctaattccaagatattatcagggcctgggattatgggcaggttatccacccaaattagctattaacttaacccagactcctaacccaatagtcataaaatttgatgcttgccaggtcctacctagattgtggaactctagaaagtcaaagacaactttcatctatagataaatatctttgtccagaactcagcccataagaactacatagacaagggggaaaatgggactaaaagtacccatgttcaagttggaatgatgtttggtggaccacccaatacaaggggtggacttccccccatgcttataatttatgatcattaagggacaagattcacacatcaaagggagagccttgtcaagatctccccttgtccacgtgtctcactttccaacactgatgacctgagccagagttatcttaatttccaacatggccattcattttattttttctcaaacctaggttttccaactgcgtgttttgtgtagatatgcacagtttacttgaattgtaaactgtgtttttcaaaaggaataattctaattgcattataatatttagctccaaaagcctactagattaacttactagggcttctataacaaagtatcacagactatgcatcttaacagaaatttagagatggtggtctttgcccctgtgtcttcacatgctcttctcccatgtcagtatcttaatctcccttttataaggacaccagtcattttggattaaggcccattgcaattattttatttaacactaattacctctttaaagatcctatctccaaataggatcaccttcagaggtcctaggatttcaacatctgaaatggaaagggagcaaaattcagcccataatagctacacttcctccactgttgttcagtcctatctaccatagatgatttgtgtttcctatatgttaaaagaatccacaactcaagaagctgattatgtggcaaatctttcttcccttaaattagtaaatgcacagatgtcaaaaatggtctgagatgaaaaattaagtgaaggcatcaaatacctctttaaaggcttctaaaactaacgacttactataattacatccaattctaccataatgagcaataccttctgtgaaaactttccacaatgagcagactaaatattttaaatgatacctgacatgattacattaagggaacaatctgttatttatcaaaataggtagctgtttttcataaatatccttttcctgaacattaagaaagggaaatgtsstgattgaaatctcacaaatgacacaaaataagaggcttctggcttcctacttgctaaatgtatgccactcagtaaaagaacactagccccaatgatgttttgcacaggaaggcaacctttgcctttttccacgtaggcctcttgtataacaagccatgtagagctgctcaaattccaaatgctctagatgcttatacaggtctttaccaacatgaaacacactcaaaatctgttccccatactgggaaaggctgatttggtatgaataggtcttcttttcactaaaggggcaatgcagtacctgggagatagaatgacacccgcatcacagcaatctcataaaacaagaagcttctagcttcctccatgaaaagtgtatttcactcagtaaaaggacaccagagccaatggtggtttccacaccaccattgcatttttaccacataggcctttgttataactaagcatttgaatttctcagctgcaaaatgctctgtgtgttctaggtgtctgcaatgggcttgactagcttggaaaccttcaaaatgtattctccatgctggaaaagtttgatctggtatgaagagacatcttttctgtgcttcccagtggtttttgacggggactcaaactaaatgttctttgacaaatggatgttactcattttttccagttttgcttatgtaatttgagcctcagccaaaacaggtgagacatataaaaatgttatttaacatttttttctgttttacacaggtggaaatacctaaacagctaattttaaagcagttacaggcaggacacattgagccttccactagtccttaaaatactccaatttttgtcataaaaaaaaaaatccggtaaatggaggctgctacaagatttaagagctattaatgccactatggagactatggggacattacagcccaatcttccctctccaatagctgtccctaaagattatgatatcataataattgaccttcaggactgttttttttcaccatacccttacaccaggaggactgcaagagatttgcatttagtcttccttctgaaaatttaaagagaacttaccaaagataccaatggaaagtgcttccacaaggcatgaaaaacagtccaacactttgtcaaaaatttgttgatgaggtcttatgtactgttagacaaaatcatcctgacctttatcttattcattatatggatgatattttacttgctcactcagattgagaagtcttacaacaactattgacaaaaacagtacaggcccttagtgatcatggattaatagtgggtccagaaaaaaattcaagttcaacctccatttacttatttagggagaattttaaatagtgagactgttacccaccaacctctaaaactgaggaaagatcatttaaatactcttaatgattttcaaaagctgttggaaatattaactggattaaaccatatttaaaatgaactactgctcagttgttgcctctatttaagttgttacagggggattctaatccaaattctcctagaactttgacctctgaggccaacgttgcattaaaagaggtggaactagcgatttcaaattgtcaattggtaaaattagattataacagggcttggagtttaattattcttttttttttgtctttttgccatttcttgggccactcctgcggcatatggaggttcccaggctaggggtagaatcggagctgtagccacaggcctacgccagagccacagcaacgcgggatccaagccacatctgcaacctacaccacagctcactgtaacgccgcatccttaacccactgagcaaggccagggattgaacccgcaacctcatggttcctagtcggatttgctaaccactgagccacgatgggaactcctaattattcttaaaacatcttactcacctatggcctgtctgtggcagcacagacctttggaatggattcttctaacagctactcctaaaaacgtcttggcttcttacccttctcagacagctgcgttaattactaaagagcgaaaaagaagagctgtttggtaaggtctgtcacgaaatcattataccttataataaacaacagtttgaaaccctccttcaggaggatgaggattggcaaattgacttaaggggtttttcaggaaaaacctcttatcatttgcctaaaagtcctttgttacagtttctaaaagaatgtgatattatttttccagtctgctattctaaaaggcctcttaaaaatgctgccttggtttttacagatgggtcatctaataaaatgcctctgtggtaattgaccaaaagaaactgataagttttcaaacaaaaaaaagtctgctcaaagagctgagttaagggcggttatagaaacattcatgttattaagaaaccaaaagtttaacttgtactcagattcaagatatattgtggggatgtttcctcatattgagactgctgttatacctatacataaaacttcaatttcttccttgcttgttgagttacaaaaacttattcacagcaggacagaatcattttttatagggcatattagagctcattctcaactgcctggtcctcttcatgaaggaaatgctaaagcagatcaatttactagactggctttattaataactgaggaggacaaaacaaaagaggcaactcagtcacaatctattcatcatcaaaatgcttctgacttaaggttacagtttaatattacaagagaagctgccagatagattgtaaaaactgtggtgtttgtcctcaaatcctttttgcttcaaaatcaggggttaattcccgtggcctcagagttaatgatttattgcagatggacgtaactcacgtcccatcctttgtagacaccttttctcatgtgattttggcctctgccaggacgggagaagattttaaagatgtaatccaacattcgttttttctgctttgctattttaggaatgcctaaaaatctaaaaacagaaaatggtccagcttatacttcaaaattctttgctgatttttgtataaaattccaaatttcacatacaactggcattccatataatcctcaaggacaagcaattatagaaagagcacatcaaacattaaaaaatcaaattactaaattataggaaggaaatttagacataattctcatcatgtgctgagtcatactatgtttgtaatcaattatttaaatgaggattcttcaggacattctccaatgtatagacattggaatacagatacattacccaaaccaatggttaaatggtaagatgttttaagcagtcaatggaaaggcccagatattcttctaacttgtggaagaggttttgcttgtttttttccccaggactcattatcacccatccgggttcctgattgcctgattagatgattagacatgtcaccaccacggccgtcaaggatgaggtgccacgttgaagacaccgaaaaagagaaaccccaaaacaaacaagtgaaggaactcctttctacatggctgaaacacttaaatctcaacctccggtggccatgacaacaactacctggtcgcttcgcaagactgacaggtgctgctcacccgcctaccggcggtcaaatagagagacttgttaaagacactgaggggttggtgagagttcaaaattaacatttaaatcctacaactatgttcattactatgcttacaattcttgcttgtcaaacaaataacgtctctactaagtcacattgggcttttttccctaatccacccaattttcagcctgttacttgggataatgagatggttaaagtacatgtaaatcagtctaacctgctggggggaccagggcttcctcctcctccttttgaaattcctacagccagttcctttaattattcattcctcaaaagctcagacattgcctatttgttttgctttgccgttaaccctttatggtcttagaccaactaatgtccctggctgaaatacttattttgtaaaagcttgtttacaggttccttatgcttttcttctttcaaaaatttttaatataaaaattcataaaaaaagatgtttttactactcaatgtgataattgtaccttgacaaattgtattagttctaatattggtaattataagtttatgcttattgtgaaatagcctccatacataatgtaatattcctgtaaatattactggtgattggtatgataatcagggattaaaaacattacaactgctcaattatcagttaacacgaaccaaacaatttgtcttatattgggaattactgccttaatttctataattacttccttaacagcattggctgttgctttaacaaaacaagtacatactgcaacttttgccgatcagttatacagaaatattactttagctttaactacacaagagattattgataaaaagttaagtgacaaggttgatgctttggaaaaagcagttatggcaatgaaacagaaaataatatctcaaagttaaattggctctttgttgccatgcagattttaaatggatttgcgttactcctctccaggtaaattcgtctcgttatacctgggataaaattaaaaatcaactagaaggagtttgaaatcactctgactttggattgaatatttctaaattatatcagaaaataatggatataaatcagggggaacaaggctttagtgctcaaaatatagcctcagatttatttaacaacataaacggttttgtgaatcacaaatctctcacctctatgctcattaatcttgctgtgtctgctttacttctgattctgctattgctgtctctcccagttctctttaaacttataggttgtaatgtttgacaactttcaactgaacttcatacattcatttttattttttttttaatattttttttaattttcccactgtacagcaagggggtcaggttatccttacatgtatacattacaattacattatttcccccaccctttcttctgttgcaacatgagtatctagacaaagttctcaatgctattcagcaggatctccttgtaaatctattctaagttgtgtctgataagcccaagctccagatccctcccactccctccccctcccatcaggcagccacaagtctctgggagcggcccaagaaatagcaaaaagacaaaaaaaaaatatttttaacgatccatacattcatttttaaaaaataaaaaaagggggatatgcggggagccaagaagatacaaggagccaaggaagggagctttcctaaatggtgcaaaactgagggcaggctccttcctaatcagaaaaaaggaccttgcctgacggcagaaaaacctgaaggcaggttcctaaccaaggaagagagctcacctgaatggtacatgctgaaggtgggcctctggataggataaaagcctgcctgaacggtgcatgctaaggtgggcttctggtcaggatgaaagcctgcctttatggtacaagccgagggcaggcctcaggttacacagctctcattttgatgttgatggggaagaattggggcattcctgggaaaacaattcccatgtttgcaccagagaacatggattgtttctcgggtgacctagtcttttctgttttattttttattcagttttcctcagtctttcctgattatttacttattattcttatttttcattcttattttcctgtggtgatttttgatttaacaaaattacaataatataataagaatatcatcctgaaggactttcccctatttaaatccaactcaattaaaacatagtgtttatctactaactagttatacagtaaactttagagttaggattttaatgaggttcatagaagttagacatatattattcttgatcaaaagaaacccagctgtgagttttgtccttgattttagaaacttgtagcggtagctggctaagttgatttgtatgttctcacactgcctctctgacaaggacactttgaagatagacactagtgtgaagacaggattttttgtgtttgtaacttcttcagcttgtgggaattggctggccatgagatggtttgtgctgggtctactctttcccacatgatatgctatgcccgtttgtccttgaattgtactcactaaatttacttaagctaaagattttaaaacatgacatatagctactgtaccatgtgatcaaaaaacaaagcctaatagttaaccaaggtactttcaacactatgatgtaatctgtagtaaaaaactgtctatataattaaccacttatgccaataaaatttgagcagtccagcaccctgaaagaagggacaaagaggctgtccatctcctctcgggatgtatacaccctggctgctggatccggttgttggagctggcctccagcacttctctatggtggaaatgcaacacatagccagcttaggctaatatctgcaggatagcattctcccaaaaaacacaaaacaagagacttttagctttctacttgcaaagtgtatgccactcattggaagagcaccagccctagtggtgtttccaccagaaaggaacccttgccttttttccacatagcctctcatataacagtgttatcgggcacctcagctgctaagtgccttgtgtgcactatttgcatgcagtgggcttaactagcttagaacacattcaaaacatattatccatgttgtaaaaggctgttttggtatgaaaaggcattcaattcattttagtagaaaggcagtccataaacagcttaggccgatacgcacacaatagcattctcataaatgacattaaaccagaggcctcttgcttgctacttgcaaagtgtttgccactcagaaaaagagcactagccccaatggccatttccacaggaaagcaacccttactttttttccaaataggcctcaagtataacaaagcttatagagctgctca

SEQ ID NO: 44 - DNA, 7441 bp, Artificial
  ss162 sequence
agccttccaggaaaagtactccctttgaggcaggtccctgatggagaaggagggcttatccaggtacatgtcctggtttccactcctgatctacattaacagaaaaagtaaactcaaaagcctgaaggaagcaaagagaacagaaacaatgcaggtcatggtattttcaggatgaggaatcaagtggtcccaaattacaaaccaaactgggatcactagcaccctagggaaggggtgggaagacagaggctgactcattataaaaatatgatcttaaaaggaatccaggcagcaggaaagaaatgtcagctggagtaagataaaggaaatatatcagaagccaagggaacccttaggcattctcagagcttcagggaatgctgccgaaactatactgtcaccaactctgtctttggaagggaatgcaatcctgaggttgtatttcatttcctaaagtgctcccaacattagcataaactcagaaactggaaatagaaccagactcccctacctcttacttggtcaaagttgcttatgtgttattaccaagatacagacggggaaaaaaatcagagaataagaagactgttggtctcccatgtcaatctgatgccaaaggaatctgtattaattgcccacagagactgtaatgagagacccccagcccacagtgtgggatagcaagccaaggaatctaggacccaaacagttccaggaggccatatgtaaacaagagggacacgacactggaagggagaatgctctcgctgccccaagggggatggaattatcggatccccgccactaaccccaaaggcagatggtccaaagagatgaaaaatgacagaaccaggtagctcctaagctggcactccaattgatccctaatgatccctggatgacactggatatagggagaaagcctgtttaattctcagttaacaccacgccacttacccagttctgaacaccagatgaagcaaactcagtcacaagagttatacaatgatgggggtatcagggaacgcccaagaatgggcattcacagggccattagaaggtaatctggatgaacatactctttcctttctgaatgtccctgaatgccctagatccctggtaggaagagctatcttacataaattgggggggtgactgtccacctggaagacaaattggagacgagcatccccttagacaaaggacacagatgataatgttaatggttgaggacaaacctccttagacagagcaagtcaatctcccctgagtatatcttgatggctgagcccagggatgggtgggataagctgtaggggccagtcccatgagagtccatctaaccctggacacacacggcccaacagaaaacagtaccctttctgttaggagggctcgttgggcattgcccctgttattcggagtctaagtgatcgggacctcattagaccatgccaatcagccaatacctcccccattcttcccataaggaaacccagtagggaataccagatggtacaggacctcagggcagtcaatgaagccaccaaagatacacatctaggagtccataattcctacaccctgctggccactctactgtccaccaggacctggtattctgtattagatttaaaatattccttcttttgtattccattaaccctagaatcacaagaaaattttgcacggcaggacccaaacacacaacataaacaatactactggacagttctgccccaaggtttcaaaaattcccccaccatctttgggaaactttagctaaagatgtaaaagatctagatctagagaagacaaccctcctctaggatgtagatgacatcctgatcaccagccacactaaggaggcctctgacaaaaatactctgagtaaccaccctgaaccacctagcagataaaggatagaaagcgtccaaaggagttcccgtcgtggcgcagtggttaacaaatccgactaggaaccatgaggttgcgggttcggtccctgcccttgctcagtgggttaatgatccggcgttgccatgagctgtggtggaggttgcagatgcggctcggatcccgcgttgctgtggctctggcgtaggccggtggctacagctccaattcaacccctagcctgggaacctccatatgccgcgggagcggcccaagaaatagcaacaacagcaacaacaaaaagacaaaaagacaaaaaaaaaaaaaaaaaaaaagcgtccaagaaaaaggttcaaatgtcacaaactagggtgacctacccaggcttcatactcacagaaggtcagagaagcctgccttaagaaaggaaagaagctattggaagatggcttaggggtttcctggggatggctaagttttgctgcatctggatccaaatagagtcttggccaaatagagtcttggcctctatttgaaatgttgaaatgaagggatgatgatccttttgagtggaattcagaatgcaaaggggccattcaaaaactgaaaaatcaggagttcccctcgtggctcagaggaaacaaatctgactaggaacaaagaggttgtgggttcagtccctggcctccctcagtgggttaagaatctggcattgccatgatctgtggtataggtcacagacgtggcttggatctggcattgtggggctgtggtgtagtctggtggttcaactctattcgacccctagctgggaacctctgtatgtcgagggcatggccctaaaaagaccaaaaacaaagaattgaaaaagcaatttcttcaggctcccaccctggccctcccagaattaattaaacccttagacctttactcataagagaaaggaggaaatgctcttgggatattagctcaaaactggggctccttactggggtggcagcttaattctctaaacaaacaattagatcaaactgcagagggatgacctccttgcccacaggcagtagcagctactacatccctgctaaaagaggatgaaaagttagcatttggtcagccaatcactatagggaccacataccaggttcgggatttagtgagttctaagggaacagaatggctataccctggaaggtcgattcaagttcagaccatgcttcagacctctggagcatgactgtatagaaaccatagacaacaatacattcccatcaccacacctaggaagtaaacctctcccaaatgcagaagaggaatggttcacagatgggagcagttttacgatagagaagaaaaggctagtgggatgacctcctgaacccaagccatagaagcagggatttctgcccaaaagatggaactgatagccctcactgagcctatagaagtcagggaagatcttaaatatttgcacagattcctggtttgtgtatgccttcctatatgcacacgatgagatttggaaggaaagatgtttgctgactgcagagaataaaaggatgaaacatggcttaagcatattgaagctcttagaagcaggacatcttccaaaaaacgtggcagtgattcattggaggagtcaccaaaagggagacacagaggcaataaagggaaacaacaaggtggacacagctgccaaaaggtgatccatccaaatatttcccagtctgcacagaggaagaattacacaaagcccccaaatcaggcttcaacagagatccaggaggctatgggtagctagttaatgaacatgagtggtacttctttcctcaaattgcagcttgttaagtcatcaagggggctcattaaggaactccctataggaggcaaactctatataattgattagttgaggtcatgctaactcctggcatgaaaagtttaaccagtcagagagtagagacaagccccaactgcccaatgagaaaccccaacaccagcacccctttcacctccccacccacccaggtccattcaaaccagagggacatatcctggagaagactaggagattgatttcattgttctgctgagaatactgagcaatttcaggcaacttctggtgctagcagacacattttctaggtggatagaagcattccacactagaactgaaatggcagctgaactggctaaggcattactaaaataagtaattcctaaatttgggcttccagcatccttacaaagtgaatggtccagcatttgtgtctcaagtgatgaagggaataatcagtactctaggcataaaaaggaccttgtgctcagcctggagaccctagtcattagggaaaatagagagatccaatcagcccttgaaacaggccttagccaagctatatttggaaactcagaaaaactggattgagttgcttctgactgccctgttcagcaagcaactagccccagggataagttaaaattatgtacatcagggcacacttgcctacaggcaacagacctagagacattgatttttgggaaaaatgtgacatgtgacccttattctcttgctaatactcgacttttatttttttcagggctgcaccatctgtggcatatgtaagttcccaggctaggagtccaatccgagctacagctgccggcttacgccacagccacgccaggttcgagccgcatcttatactacagctcatggcaacaccagatccttaacccactaggtgaggccagggatcgaacctgcatcctcatggatactagtcaggtttgttaccgttgggacaccactagaactcttcttgctaatatttgggttgtgtatcttaaattgtctggggtcccttgtttctacaaggttagacaaaatgggggtcgctcaggcacacacacagtcacagctgaggcctggggcaatcacctataaacaaagggcagttgagaagttccgatcctctgccccagggttatttacaacacccacacatagcaggaagtagtaacagaagagggacctgtgcctctcagagcccctgtaaaaaggagaactgaagacagaggaggcatttgtcaccagcaaagcctattaattccaggggaataaaaatgcaatctgggtaacagagtctaaccttattgtcttttcctttgtgcttagtttcacttgttcccaggggacggaatgcagaggcctctcacctggcacttcggaccagagctcctagtgcaaaacgactgcacccaacacctcaagtcagacgacccattgcagaagcgctgagcaggaccggcggttcaagatggcggtggcgggctgtgtgcagtgatgctgccccggacgctgcgatttggagccgtgagcagcacagctgcggctgcgctgtgagaactccaccccctccgctgacagatccctcttaaggagccccgcccacagcttgtcgggaaagtgagtgtttaccctgtagtgaaaatgcctaaatctcactcctttgatccgagaataaggattgccttctgaacccaactcagtctccaaagacatcaggcaggaggatccttgttggagactgactcagggggttctgaaacacccgcaccctctggttccagaaggataaccaagactttgtgtcactgatgtgctcatgactgagcacagctacatggatctttgcttttaatgtattcattgaggagttcccgtgatggctcagtggtaatgaacccaagtagtttccatgaggatgcaggtttgatccctggcctcgctcagtgggttaaggatctggcgttgccggtaagctgtcctataggtggcagatgcggctcagatcaggcatagctgtggctgtggtgtatgcttttagctacagctccagttctaccctagcctggaaacttccatatgccatgggtggtgcagccctaaaaaaggacataattaataaataaagaattcattgagattaaaagtagaagaaaatgaaggaagagtacctaaaaggtagaagataaaaatcttattttagaaaatgcgtatgttccaacaaactgggagaagaatttcaggctcctaaggttcagaagactaaagttatgggttctttatggggaagacggctggttgtccatatggactaggcactgagaaccttggcctaagtgctccagcaaagtttctaataatggggcaccaacagaatagagcttctagaacaaccactagcttttgaatggaccaagaatggtttctgaaacaatcgtagacagaagcggctatttagcttcaggtagaggggtaagttctgaagcttggctgttacttgattttggtgattaggccttagatcaagtttcatctggttgtcatggataagtgaaatctgttatgtacaaatagatataattcataatatgcaaatattataagctgctggaggaagtctttcagaagacatgaccaccagtttgacctgcttgctggacttcagcaattggagctccttaccctcatccttatcctaggaaatgtactctgattgcattccccatcctagtgagacaggagggaaagaggtaggacacaaatgctagataatgaagaagggtgcagccgttgggatgagataaagactggctggaaccagctgaaactaaggtggctttgagaatagtctggccattgacatttagctcatgataccttcattgtaatattaaaaatcactccccctcatgccatgacagtttcaagttggaccattaaaggccaaaatttgggcaactgcccagtttctgggaaatcctcctactcgttagcctatgaaattacttaacccataaaaacctgcaaccgcatgctcaatttctgagccagtatgcattctgcccatggagtgtgtatctctgaataaacttgctcttcctctactctagctcactcttgaagtctttcccatttaaagccaagaaccttcacttggtggtccatcctaagatccaggacatgacatttccctcacctacaacactagaagctgctcaaggacacagccttatgaaaatgatgtggtgttgagactcttcagtgtatggcactgaatccaggcaaagtttctatatagacttttaagatgtggagggcaggtgtggagatctgctcatctttccgtggcccaagacaggcgcggtaagttcccttgctttttgaacctgctgcctatcagtctaaaatggttggccagtggttggtctctccccctgttctttgtatatggggtaggaggtttcttcagatttcacccaggaagctctggaggaggttcatgaaccaacatcagcaaagagattccaggattatacctggaaatatagcagaatgggggaaaattatggtcttaaatgctggaatcaagattcattttagggagtatcttagtttaggtcttccaagaagcagatgaaattatatgggcaatagatttactgaggagaaagacataaaggcaaggggggagggggc

SEQ ID NO: 45 - DNA, 13804 bp, Artificial
  ss175 sequence
ggaggcataactctctcagacttcagacaatattacaaagctacagtcattacgacagtgtggtactggtacaaaaacacacatatagaccaatggaacagaatagagaacccagaaataaatccagacacctatggtcaattaattttctacaaaagaggcaagaatataaaatgggaaaaagacagtctcttcaggaagtggtgctgggaaaactggacagccgcatgtaaaccaatgaaactgggacagactctcacaccatgcacaaaagtaaattcaaaatggcttaaagacttaaatataagacaagacaccataaaactcctagaaaataacataggcaaaacattctctgacaacaactttacaaatgccttacaaacccaaggcaacagaaaaaaaaaattaaaaaaaaaaaacaaaatagacggcacctaatcaaactgacaagctttttgcacagcaaaggaaaccataaaaagaaaaaaagacaatgtatggaatgagagaaaataatttcaaatgatgcaactgacaagggcttaatctctaaaatatacaaagaactcatacaactcaaccgtaaaaatacaaaaaatccaactgaaaaatgggccagcagaccaattgatccgtaggggactagtcctcccggcatgccaaggcaaggaccctgagagcacaacagaatccagtgaggcccaggaaccagcaaagggagcgcatcctgtcagactggtaagaacctgggttcaggagttcccgtcgtggcgcagtggttaacgaatccgactaggaaccatgaggttgcgggttcgatccctgcccttgctcagtgggttaacgatccggcgttgccgtgagctgtggtgtaggttgcagacgcggctcggatcccgcgttgctgtggctctggcgtaggtcagtggctacagctccgattagacccctagcctgggaacctccatatgccgcaggaggggcccaagaaatagcaaaaagacagaaaaaaaaaagaacctgggttcaatttggtaagcctgcccctaagaggcagaaggggaacctgatcacctcccagaattgcccgagtagtctcacatgagacaaaactgcgactctaaggcactgggaggaggattggagaggttgtatgaatgtaagtgaatgagagagaggacgggagagttccaactcaaccagatgggctgaagcgagtgttgagtcccgatccatggtgatcctcatacaccttatggtggctctctttggagatgtcctgacactggggtttatacagtcccaccaatgctaagaggtgcctgaaatataagaggtgcctgaaatatttgccccaggagagtggctggagacagacaaagcgattgattactgcttccctttcccttccttgtgtgtgactgttgtcttttagggggaggaaatgggtggcaaacagagtaaacataccgccttagagtgtatgataaaaaatttcaagaagggatatttaggagattatggtattaagttgactcccagaaaactccagatgttctgtgagatagattggcctttgttcagggtgggtgggcctcccaaggggtcactagataaagaactagttaacaaagtatttagagtcatcacaggtgacccaggacacccagaccaattcccttacattgactgatggcaagacttggtcctttctcagccaccttggctaaaagcctgtcaggaagaaaactataaaattatgatggctcgaataacagccccctcaaaatactgaaatgctgaccagaatccaagaagcccattttatctgagaaccagaggaaatttctctaccttatgcaccactgtaccctccactgtcgcctacacttccagcattgggggccataccagaggtggctgcctcccccaagaggagcccctcccctgacttacccatgacatcaccagtcacgacctctcccaagcctccagtgctaatcctgtatactctggctggaaggcaactgagaagtcgggccagcagggatagccctctccaccatggtgccagggggccctacagatgccactgagggagaccagagggcctctctattttgatcaagagggtcaaatttgaagaggccaatgtgtttgtgtaccaacccttcaccaccactgaccttctcagttggaaaaatcatactccctcctacactgagaagccccaggctacgatggatctaatgcagtccatcattcaaacccacaagcctacctggactgattgccatcagcttctcctgactctgtttaacactgaataatggcaccaaattactcaggcggctttaagatggctagaagaacacgtcccggctgaaataataaatacacaggcttacacccagagccatttccctgagaaaaatcctccctgggaccctaatgacactcagaaatttcagaagaagctcttttaaatggcatgaaggaaggggccgaggtcaaggaagaagccgacgggaggaccacctcacaccgagatgagactggggcgaaaaccaatgtgctcactgccatcaagaaggccactggaagaatgaatgcccccagtggtaagagaattattatccaacttccggacggagagggaaaggcaaggtgattcagggacagtaccaaccagtgcagcaaccattgaggcccccaagagtgactttatgggtctggctgctatgggaaaccatgaggaagactagggccattctattaggcccccaggaacccatgatccaaatgaccagagggggccggcccattgacttcatggtggataccagggcagaacattctgtggtgactcaacccgtgggccccctctcgtggagacaaatcactattgtgggagccactggtgaccaaatctgtcgccccgcccccttttctttggtctttttgcttttttgagggccgttcctgtggcatatggagcttcccaggctaggggttgaatcagagctgtagtcaccagcccacaccagagccacagcaatgtgggatccgagctgcgtctgcgacctacaccacagctcacggcaatgtcggatccttaacccactgagcaaggccagggatcgaacctgcaacctcatggttcctagttggattcgttaaccactgcgccacaacgggaactccatcatcgccctttttttttactaccttgatgtgcaatctgggtggccatgaagttatacacaaatccctatacctccctgactgccctgtggctttgataggtcaggacttattgggaaagctacagacccagataactttcacctcccatggccaaacggccttgactctagggaagccaggggcaaatattatgactctcacagtcccctgaggagaagaatggcgcctctatggtcttgcagggaggccatggccaagacccgagcttccttttaagctacctgggataggctgaagacaggccccttggactcccggaacatacccccaatagtagtagaactaaaacgaggggttgagcctgcctgccagaaacaatattttattccccatggagcacaaatagggactcagaaacatctggagagacttctaaaatatgggatcctccgaccctacctgtcatcttggaacacgcctctcctgctggttcaaaaaccagggacagacgactaccagccagttcaagacctgtgagcggtaagtaaaccaagccacatgaccctgcacccagtcatccctaatccctacactctcttgggccttatccccaccaaagctgccttctttacatgtgtggacctcaaagatgccttcttctgcatctgcctggctccttagagttaaccaatttttgccttccaatggcagaatctggaggatggtgacaaaggtcagctgacctggaccaggtttcctcaaggattcaagaactctccaacccatcttgggtactgcattagcctctgacttaaaggccttcccagcaggccagtatggctgtatggtgctccagtatgtagacaatttgctacctggcagacaaaggaaagttgtatggaagggacacgtctgcttctcgctttatgggaggctggctacaaggtttcaaggaaaaaggcctagatctgtcaaggaaaagttaaataccttggctttcacctatcccagggacgtcaacttggcccagagagaaagcaggctgtctgctcaatcccagttccctccacccgacgtaaggtttgagaatttctcagggctgtaggtttctgcaggatctgggtacccaacttatccactttagcgaaacccctttatgaggccacaaagggggtgtagtgggaacctctgttgtgggaataagtgcaacaaaaggcttttaaagagatcaagtgatccctctccaacacacctggcttgggactgtcaggaatctctaagccctttttcttgtacgtgcacaagcacactggggtggcagtagaggtcttaactcaaatgctggggtcatggcatcatccagtggcatatctttccaagcaacttgactccattgcccaaggatggccaccctgcctgcgggcacttgcagccacagcactcttagtgtcggaaactgataaattgactatggaacaagaactaacagtctaagtgtcacattcagtgccgacattaatggagaagggacaatactagctaactaacacccagatggtcaaatatcagggaatgttatgtgaaaatccgtgcattcacctggaggtggtgaggaccttaaacctgcaaccctactacttgttgggccagggcagccagatcatgactgtattgaagtcacggatgaggtattttccagccgaccaaatttaacagaccagccccttgaagactcagatgctgaatatttcactgatggtagtagctttgtaaaagagggagaacgccttgctgggtattccatggtgaccctacattccaccactgaagcaaaagttctgccaaaagggacttccatgcaaaaggcagaactcatcacactgagctctctgactggcagcagggatacatgtcaatatatacaccgactgcaaatacgccttcaccaccctccatgtacatgggtctctatataaagaaaagaggctaatcgactcaggagggaaggatataaagtatggcaaagagatccttgacctcttagacactgtatgggcccctaaaaaggtggcagtcatacactgtcggggacatcaaagagggaccaccacagttgcttggggaaaccgtaaagcagaccaagaagcaaatctcacagcctccaaagggacgaaagaattcagcggctctgatagccgcactgctccctagtccattggcagaatgggatccagattactcacattatgaaaacacctggttccaaactgagactggaaactacctcccaggtgaatgctggaaatttgaagacggctgaattgcaattcttgagacccaagccccagcctttgtcaaacaattgcatcaggagactcacactggccaaatggctctcgagaccacactgggcccacacttctacatacctcggcttgccagcacagcccaggtaatacgcgagcagtgtgaaacgtgtgcccggaataacccgcgtcaggggcctagggccacccatggaatacagagtgttggaggggccccattcgaaaatacaattgtggatttcactgagcttccctgagtccgaggctttaagtatctgttagtctttgtgtgtacattctcaggttggatagacgccttcccaactcgcacagagaaggcacatgaggtggcctgattcctcctaaaggaaatcattccctggtttgtgattccaatcaccactggattggacaatgggccagcatttgtggtggaggtagtgcaactggtggcaaagggattaaaaatcacctggaagttgcacacagcctatcggccccagagctccggaaaggtgagacagatgaatcggactctaaaattacaattaagcaaactgtgccaggagacacacttgcattgggaccagctcatgccagtagccttgctaaaaattaggtccagccctactaagcagactgggttttcccctgatgaaatctgctatgggcgccccctcctctcattaagggtataaggggggacttaaaggaactagggaaccttaccctgaggcaacagatgcaggcactaggttccaccctggccaccctccatcagtgggttagggaacgattacctgtaagcctaaccacagacacccagcccttcaaaccaggggatgctgctatatgggtaaaagagttcaatgtccagcattaaaacctctttggaggggcccatgtactgtcattttatccacccctacttcagtaaaggtggcagaagtggctccttggacccaccacagcagagcaaaaccagcatctcgagatggagtgcatcgctgatccctcaacactgttcaagctgaccatctgaaagaaacaagctgcagcttagaaacccatgaggatgacagccctgctctagtcactctagaagctgactgtctacacatggcaggagcttgaggagtcagccaccagagaggataaatagactgtatccattcctcatttcagtccctttactgtgatgtactgccatcccttgtacctgtctgttattgtggtcattgtcctaatctttgcaataggctggtggaaactgctccggccaattggaaatgtggcaaaaggtccctgcttgcactctgcttcctcttctgtgtaggatattttgttgttattggttgcttctggtctgagcctcttttgcccctcttgtagactcaaattccaccccttctgataagtgtatggggaagatttcgtatcaagggaaggttggattgtccctcacctccaattcctaccaaccacctgcttgttatcgaggtaccacccccaccctttgcatatacaatggtaaaagttattggatgggatggataaaaacaaaatacctggaggggcacacttgccagggaccaaagagaaggggaataggggcttgggcctgttggacatatagcggacactgaggcatgtctgatggaggggaagttcaggaccaggcccaggcccagctagtcacagatatacaaaaactatacaaaagataaaacaataggcaggcccaaggcccctgcaatcggggtccagcctagtctatgaccaactcaggaaggacctgggtccagacgtggacttccctacctagggacgaatcttttcactgacctagctgaaaggattgcccatgaattcaatgtcactgattgttgggtctgtggagggacccttatgagtgaagaatggccttggaaggggaccagcctaaatgcactccacttacttcaatggaatcattccataacagagagagaaaacaattggtgccaaagttgggtcttggcctcagaggtaattggagaaaaatgcattggtaggacaggacccggttacacacaatgggtaggagaaactccaggcaaaagaaggctttcttggaactctaccagctttgaggggtagccaaacatttctacctggcattgggccctggcatccatggttaacaccttccagtgccaatcctctccctatcaagtcatagtcaactgtactacacaaactgaggaggccaatcattccattgcatacgtgaaataagtaaacactgggacaaccttactcttagcaaccccgaacactggagggcacctgatggactgttttggatatgtggtaaaagagcatatccacaactccctgctcgatagaaagggagctgcaccatcagaataatccaaccaggattcttcctcctacctaaccaggaggaagaaaaattagggactctcctttatcagagcctaaaggttagaaccagaaggagccctgtgacaggaagacaacaaagatgaggggaaaatgagtggccaccccagaggattattgagacatatggtccagccacttgggcacaagatgggagttggggctaacaaatccctatatatatatgcttaatcaaatcatcaggttacaggtggtactggaaattattactaaccaaacagccgaagccctagaactcgtggcaaaacaacaatagtagatgtgctcagctatttaccagaactgcctagccttagattacctattagcagaagaaggaggggtatgcggaaaatttaatcaatccgactgctgcctccagatagatgacaatggccaggccatgactaacatagccacaaacatcagaaaagtggctcatgtccccatacagacttggaaaggctgaaaccccagaaagctattcgggggatggttttcaacctttgggggattcaaaaccctcataggtatcatgctcctgaacttgggaggctgtttgatattaccctgtctggctcccctagttataagatctgtctctagcctcattgagaccatggtcaaaaggaaaatggcatcatgcatgtgatgatgctatggaaatataaacccctagcccaagatgatgctctttaaccctgagagagggatcagaacatcaaagggggcaatgtagtggggagggggagagggtgtctcagaacaaagggaaggcaatgtgcaccatcagcatctatgtgcacatctgcagttctgtgacagtataacataactggtatccatgtgcacaggcatatctgtgtaacatgacctatccactcagaagttacagaatgcttgttaccttataagggggacaaagggaccaagatgtagcaggaaacctaatggggatgtataagcaacaccccgctgcattaggggctcagcctctggatacaaatccgctaagcctgtgccagcatgaataaacactgcttcctggcaaaggcctcagtgtcctgtctttctatacgtgagtcctactatactcagccataaaaaagaataaaataatgccatttgcagcaacatggatggaactagaaactctcatactaagtgaaataagtcagaaagagaaagacaaatatcatatgatatcatctgtatctagaatctaatatatggcacaaatgaacctatttacagaaaagaaacaaactcatggacttggagaacagacttgtggttgccaagggggaggaggagggagtgggatagactgggagttaggggttagtagatgcaaattattgctttgggagtggataagcaatgagatcctgctgtatagcacaaggaactatatctagccacttgtgatggaacatgatggaggataatttaaggaaaaaaaatgtacatatatgtatatatatgactgggtcactctgctatacagcagaaactgacagaacattgtaaatcaactataatggaaaaattaaaaatcttaaaaaattaaaaatacaatgaaacaaaataaacccagggaggaacagcccaagacacgtattaatcaaactgaccaaattaaagacaaaaagaaaatactgaaagtagctaaggaaaaaaaataaataacatatgagggaaccctgataaagctgattatcagggttaatcaaaatgatgcaagacattggaaacaaactggaggcaaagattgataatttacagcaaacactgagcaaaaaaatacaagatttaaaacttaagcaagcagagatgcaaaatacaaaaactgatataaaaaaaaatcattagaagcaaccaacagcagaatataggaggcagaagaatgaataagcaaggtggagggcagactagtggaaatgccttaatgtggaacagaaaatagaaaaaagattgaaaagaaacaaagatggtctaagagaactctggggcaacattaaaagcaccaacatgtgtattatagggctgctagaaggtgaagagagagagaaagggacagaaaaaatattcaaagagataatagccgaaaacttccctaacacgggaaaggaaccactcactcaaatccaggaagcacaacgagtaccatataaaataaacccaaggaggaacacaccaagacaaatattaatcaaactgatcaaaattaaagacaaagagaaaatattgaaagcagctagggaaaagaacaaataatatacaagggaaaccaaataaggttaccagcagaattttcagcagaaactgcaggcacaatatgcgtgtgatgaaagaaaaaagcctccaaccaagattactctacccagcaaggctctcattcagatttgaaggagaaatcaaaagctttacagacaaacaaaagctaagagaattcagcaacactaaaccagctttaccacaaatactaaaggaacttctctaggcagaaaagaaaaggccacaactagaaacaaaaatactacaaatgataagaatcatcaataaaggcatacatatagtaaaggtaggaaatcatccatgcacaaatgtgctaccaaaatcagaaatcatgaggagaaaagggtacaaaatgcaggacactggagatacacttgcaattaagagaccaacaacttgaaacaatttcatatatatcaaaactctggggtaactgcaagccaaaaatctatcacacatacaagaaaaatcaactcaagtacaacactaaagatagtcatcaaaccacaagaagagagaacaagagaagaagggaagaaaaaagaccaacaaaaacaaatccaaaacagttaataaaatggcaataagaacatacatatcaataactaccttaaatgtacatggactaaatgccccaaccaaaagacaaagactggttgaatgatacaaaaacaagaaccatatacatgctgtcttcgagagacccacccatttctagggacacatatgaatacaaagtgagaggatggaagaaagtattccatgcaaataggaatcacaagaaagctggagaagcaatactcatttcagacaaaatagaccttaaaaataaagaatattataagagacaaagaaggacattacataatgatcaaaggatcaatccaagaagatataacaattataaatatatagaaatcatagaggaaactaaaaaatacttagaaacaaataacaaagacacaacaatccaaaactaatgggatgcaacaaaagcagttctaagagggaagtttatggctatgcaagcctacctcaggaaataaggaaaatctcaaataaacaacctaactttacatctcaagcaagtagagaaagaagaacagacaaaacccaacattagcagaaggaaagaaatcataaatatcagaacagaaataaatgaaatagaaatgaagaaagccacagaaaagagcaatgaaactaaaaagctggtttttgaaaagatcaacaaatcctcagcaggattcattaaggaaaaaaaagaggactcaagtcaataaaattagaaatgaaaaaggagaagttacaatacacatcacagaaatacaaaggatcataagagactactacgagcaattatatgccaataaaatggacaacttagaagaaatgcacaaatacttagaaaagtacaatccccaagattaaaccaagacaaaagaagaaagatgaatggaccaatcacaagtactgaaactgaaaatgtgactaaaaagcttgcaacaaacaaaagtccaggacaagatggcttcacaggcgaatatttagagaagagataatacctattcttctgaaactattcccaaaaactgcagaggaagacacacttccaaactcattctatgaggccaccatcatcctgatgcaaaaaccagacaaagatacaaaacaaacaaaaatgaaaagaaaagaaaaaagaaagaaagaaaattacaggctaatatcacttatgaacacagatgcaaaaattctcacaagatgctagcaaacagaatccaacaatgcactggattgtacaccatgatcaagtggaattaatttcagggatgcaaggatttttcaatatccacaaatcaatcagtgtgacacaacacattacaaattgcagaataaaaccatatgatcctctcaacagatgcagaaaaagcttttgaccaaatcccaattccgataaaaactctccagcattgctgtggctctggcataggccagcagctacagctccaattagacccctagcctgggaacctccatatgccgcaggagtggcccaagaaatagcaaaaaaagacagaaaaacaaaaacaactctccagaaagtgggcatagagggaacctacctcaacataataaatgccatatgtgacaaacccacagctaacatcattcttaacagtgaaaagctgaaagaattcccgctaagatcaggaataagacaaggatgtctgctcttgccactactattcaatacggctttggaagtcctagccatggcaatcatggacgaaaaagaaaaggaatccaaattggaaaggaagaagtaaaactatttctgtttgcagatgacatgatattatacctagaaaaaaatcctaaagatgctacaagaaaactgttagggctcatcaatgaatttggtaaagttgcaggttacaaaattaatacacagaaatcaacgcacttctatatatactaagaatgaaagatcagaaaaagacaatcccatttaccatcacatcgaaaagaataaaacacctaggaataaacctatctaaagagataaaacacctgtactctgaaaactataagatgctgatgtaagaaatcaaagctgaaacacatggaaaaatatgccatgctcttcctatatacaatagccaagacatagaaacaacctaaatgtccactgacagaatagtggataaagaaaatatggtacatatacacaatggaatattactcagccattaaaaagaaagaaataacggcatttacagcaacatggatggacctagaaattatcatgctaagtgaagttagtcagacaatgagacactaacatcaaatgctatcacttacatgtggaatctaaaaaaaaaggacacaacgaacttctttgcagaacggatactgactcacagactttgaaaaacttatggtttccaaaggagacaggttgggggggtaggagggatgggctgagggtttgtgatagaaatgctgtaaaatttggttgtgatgattgttgtacacctataaatataataaaatgcattaagtaattttaaaaaataccatgctcttggattgcaagaatcaatattgtcaaatggcaatctacagattcaatgtaatctctatcgaattaccaatggcatttttccacaaaactagaacaaaatattttcaagtttttttggaagcatgaaagacccagaatagccaaagccatcctgagaaagaaacaaaatggagctggaggaatcaggctccctgactttagactattctacaaagctagtcatttaaacatcatggtactggcacaaaaacagaaatgcagatcagtggaacaggatagaaagcccagaattaaaaccatgcacctacccacggtcaactaatctacgacaaggaggcaagaatacacaatggggaaaagacagtcccttcaacaaatggtgctgggaaatctggacagctacacgtaaaagaatgaaattagaatgctcccaaacaca

SEQ ID NO: 46 - DNA, 7762 bp, Artificial
  ss191 sequence
  misc_feature (1414)..(1513): n is a, c, g, or t
tgaaaggatgaaaatgcaacctgactctcccagaacccaggaagttaataagaagctctaaatgccctcgaattccagaccctgttccctataggtaaaagatcatactttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcataagataaaaagaggagaagtcaattgcctaacggaccccagtaagatcgggcgtgccacaaaatgttgaaaatcctgataaatatatcttggtgacaatatgtctcccccacccagagacaggcacaaacatgtaactccagaacaacttaaaattaattggtccacaaagcgcgggctctcgaagttttgaattgactggtttgcgatattttaaaaatgattagtttgtaaaagcgcgggctttgttgtgaaccccataaaagctgtcccgactccacactcggggccgcagtcctctacccctgcgtggcgtacgactgtgggccccagcgcgctcggaataaaaatcctcttgctgtttgcatcaagaccgcttctcgtgagtgatttggggtgtcgcctcttccgagtcaggacgagagggattttaactcgactggcctttcagtttggtgcgttggccgggaaacccgcgactacccctcacacccgagaaccgacttggaggtaaagggatcccctttggaacgtgtgagtgtgtgtgtcggctggcgtctctgttctgagtgtctgttttcggtgatgcgcgctttcggtttgcagctgtcctctcagaccgtaaggactgggggactgtgatcagcagacgtgctaggaggatcacaggctgccaccctgggggacgccccgggaggtggggagagccagggacgcctggtggtctccttctgtcggtcagaggaccgagttctgttgttgaagcgaaagcttccccctccgcggccgtccgactcttttgcctgcttgtggaagacgcggacgggtcgcgtgtgtctggatctgttggtttctgttttgtgtgtctttgtcttgtgcgtccttgtctacagttttaatatgggacagacggtgacgacccctttaaattggacgcccggccactggcttgcagtccctcagatggtctctagtggatcccccggcatctcaatctatcaatgttccacggtcgcttggtgcagggcgatgcagaacggatgatctgtcctgttttcccgaggagacgcctccttgtccttgttgcaagaaccagcctcatgggggtgagaaaggctgaagccattcgcacccccatgaggctggatctagcaacaaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagggaaacaaaggactgaaggtcttagctctgaaagaagataaagactagggaagacggggttcggaccccctccccgagcccagggtaactttaaaggtggaggggcaaccagttgagtttctggttgataccggagcgaaacattcagtgctactacagccattaggaaaactaaaagataaaaaatcctgggtgatgggtgccacagggcaacaacaatatccatggactacccgaagaacagttgacttgggagtgggacgggtaacccactcgtttctggtcatacctgagtgcccagcacccctcttaggtagagacttactgaccaagatgggagcacaaatttcttttgaacaagggaaaccagaagtgtctgcaaataacaaacctatcactgtgttgaccctccaattagatgacgaatatcgactatattctcccctagtaaagcctgatcaaaatatacaattctggttggaacagtttccccaagcctgggcagaaaccgcagggatgggtttggcaaagcaagttcccccacaggttattcaactgaaagccagtgctgcaccagtgtcagtcagacagtaccccttgagtaaagaagctcgagaaggaattcggccgcatgttcaaagattaatccaacagggcatcctagttcctgtccaatctccctggaatactcccctgctaccggttagaaagcctgggactaatgactatcgaccagtacaggacttgagagaggtcaataaacgggtgcaggatatacacccaacagtcccgaacccttataacctcttgtgtgctctcccaccccaacggagctggtatacagtattggacttaaaggatgccttcttctgcctgagactacatcccactagccaaccactttttgccttcgaatggagagatccaggtgcgggaagaaccgggcagctcacttggactcgactgccccaagggttcaaaaactccccgaccatctttgacgaagccctacacagagacctggccaacttcaggatccaacacccccaggtgaccctcctccagtacgtggatgacctgcttctggcgggagccaccaaacaggactgcttagaaggtacgaaggcactactgctggaattgtctgacctaggctacagagcctccgctaagaaggcccagatttgcaggagagaggtaacatacttggggtacagtttgcggggcgggcagcgatggctgacggaggcacggaagagaactgtagtccagataccggccccaaccacagccaaacaagtgagagagtttttggggacagctggattttgcagactgtggatcccggggtttgcgaccttagcagccccactctacccactaaccaaagaaaaaggggaattctcctgggctcctgagcaccagaaggcatttgatgctatcaaaaaggccctgctgagcgcacctgctctggccctccctgacgtgactaaaccctttaccctttatgtggatgagcgtaagggagtagcccggggagttttaacccaaactctaggaccatggaggagacctgttgcctacctgtcaaagaagctcgatcctgtagccagtggttggcccatatgcctgaaggctatcgcagctgtggccatactggtcaaggacgctgacaaattgactttgggacagaatataactgtaatagccccccatgcgttggagaacatcgttcggcagcccccagaccgatggatgaccaacgcccgcatgacccactatcaaagcctgcttctcacagagagggtcacgttcgctccaccagccgctctcaaccctgccactcttctgcctgaagagactgatgaaccagtgactcatgattgccatcaactattgattgaggagactggggtccgcaaggaccttacagacataccgctgactggagaaatgttaacctggttcactgacggaagcagctatgtggtggaaggtaagaggatggctggggcggcggtggtggacgggacccgcacgatctgggccagcagcctgccggaaggaacttcagcacaaaaggctgagctcatggccctcacgcaagctttgcggctggccgaagggaaatccataaacatttatacagacagcaggtatgcctttgcgactgcacacgtacacggggccatctataagcaaagggggttgcttacctcagcagggagggaaataaagaacaaagaggaaattctaagcctattagaagccttacatttgccaaaaaggctagctattatacactgtcctggacatcagaaagccaaagatcccatatccagagggaaccagatggctgaccgggttgccaagcaggcagcccagggtgttaaccttctgcctatgatagaaacacccaaagccccagaacccggacgacagtacaccctagaagactggcaagaaataaaaaagatagaccagttctctgaaactccggaggggacctgctatacctcagatgggaaggaaatcctgccccacaaagaagggttagaatatgtccaacagatacatcgtctaacccacctaggaactaaacacctgcagcagttggtcagaacatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaagaaaatactggaggaaatttttccaagatttggaatacctaaggtaatagggtcagacaatggtccagctttcgttgcccaggtaagtcagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggtgaggaacacccctggacagtttgggctgaccccctatgaattgctctacgggggaccccccccgttggcagaaattgcctttgcacatagtgctgatgtgctgctttcccagcctttgttctctaggctcaaggcgctcgagtgggtgaggcagcgagcgtggaagcagctccgggaggcctactcaggaggagacttgcaagttccacatcgcttccaagttggagattcagtctatgttagacgccaccgtgcaggaaacctcgagactcggtggaagggaccttatctcgtacttttgaccacaccaacggctgtgaaagtcgaaggaatccccacctggatccatgcatcccacgttaagccggcgccacctcccgattcggggtggaaagccgaaaagactgaaaatccccttaagcttcgcctccatcgcgtggttccttactctgtcaataactcctcaagttaatggtaaacgccttgtggacagcccgaactcccataaacccttatctctcacctggttacttactgactccggtacaggtattaatattaacagcactcaaggggaggctcccttggggacctggtggcctgaattatatgtctgccttcgatcagtaatccctggtctcaatgaccaggccacaccccccgatgtactccgtgcttacgggttttacgtttgcccaggacccccaaataatgaagaatattgtggaaatcctcaggatttcttttgcaagcaatggagctgcgtaacttctaatgatgggaattggaaatggccagtctctcagcaagacagagtaagttactcttttgttaacaatcctaccagttataatcaatttaattatggccatgggagatggaaagattggcaacagcgggtacaaaaagatgtacgaaataagcaaataagctgtcattcgttagacctagattacttaaaaataagtttcactgaaaaaggaaaacaagaaaatattcaaaagtgggtaaatggtatgtcttggggaatagtgtactatggaggctctgggagaaagaaaggatctgttctgactattcgcctcagaatagaaactcagatggaacctccggttgctataggaccaaataagggtttggccgaacaaggacctccaatccaagaacagaggccatctcctaacccctctgattacaatacaacctctggatcagtccccactgagcctaacatcactattaaaacaggggcgaaactttttaacctcatccagggagcttttcaagctcttaactccacgactccagaggctacctcttcttgttggctttgcttagcttcgggcccaccttactatgagggaatggctagaggagggaaattcaatgtgacaaaggaacatagagaccaatgtacatggggatcccaaaataagcttacccttactgaggtttctggaaaaggcacctgcatagggatggttcccccatcccaccaacacctttgtaaccacactgaagcctttaatcgaacctctgagagtcagtatctggtacctggttatgacaggtggtgggcatgtaatactggattaaccccttgtgtttccaccttggttttcaaccaaactaaagacttttgcgttatggtccaaattgtcccccgggtgtactactatcccgaaaaagcagtccttgatgaatatgactatagatataatcggccaaaaagagagcccatatccctgacactagctgtaatgctcggattgggaatggctgcaggcgtgggaacaggaacggctgccctaatcacaggaccgcaacagctggagaaaggacttagtaacctacatcgaattgtaacggaagatctccaagccctagaaaaatctgtcagtaacctggaggaatccctaacctccttatctgaagtggttctacagaacagaagggggttagatctgttatttctaaaagaaggagggttatgtgtagccgtaaaagaggaatgctgctttgatgtggatcattcaggagctatcagggactccatgagcaagctcagagaaaggttagaaaatcgtcacaaagaaaaagaggctggccaaggatggtttgagggatggttcaacaagtccccatgggtgaccaccctgctttctgctctaacaggacccctagtaatactgctcctgttgcttacagttgggccttgcttaattaatcggtttgttgcctttgttagagaacaagtgagtgcagttcggatcatggtacttagacagcagtaccaaggccttccaagctaaggagaaactgacctttagccttcctagttctaagattagaactattaacaagagaagaagtggggaatgaaaggatgaaaatgcaacctgactctcccagaacccaggaagttaataagaagctctaaatgccctcgaattccagaccctgttccctataggtaaaagatcatactttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcataagataaaaagaggagaagtcaattgcctaacggaccccagtaagatcgggcgtgccacaaaatgttgaaaatcctgataaatatatcttggtgacaatatgtctcccccacccagagacaggcacaaacatgtaactccagaacaacttaaaattaattggtccacaaagcgcgggctctcgaagttttgaattgactggtttgcgatattttaaaaatgattagtttgtaaaagcgcgggctttgttgtgaaccccataaaagctgtcccgactccacactcggggccgcagtcctctacccctgcgtggcgtacgactgtgggccccagcgcgctcggaataaaaatcctcttgctgtttgcatcaagaccgcttctcgtgagtgatttggggtgtcgcctcttccgagtcaggacgagagggattttaactcgactggcctttcactacc

SEQ ID NO: 47 - DNA, 11772 bp, Artificial
  ss211 sequence
tggcgcagtggttaacgaatccgactaggaaccatgaggttgcgggttcggtccctgcccttgctcagtgggttaacgatctggcgttgccgtgagctgtggtctaggttgcagacgcggctcggatcccgccttgctgtggctctggcgtaggccagtggctacagctccgattcaaccccttgcctgggaacctccatatgccgcggagcggcccaagaaatagcaacaacaacaacaacaacaacaacaaaaaagacaaaagacaaaaaaaaaaaaaggtattttggacatttcatagctttgctccaaaagaaaaccagttgctttcaagagttgaggctattgaatacattttatcttttggtcacaaacttatctaaaaacatttagaatgtgtggtaggggccctcccaggacaaagggaaggcagcatggcatgaccagcatctgtgcgcccatgtctaattctgtggcagcgtgacataatcagtatctgtgtgtgcatttgcaactatgtaacatggacgatccaataagaatttacagaatgtatgttaccttagaaggaggaaaaagggaccaaaatgtaaaggggaaactagcagaggtatacaaggcaatgccctgctgggttccgggtttagcctttggatgtgaatctgctgagccagtgccagcatgaataaactctgcttcctggaaataagcctctggtgtcctgtctctctgtacaagaatcctgcagcatttcttgggggctcattcgggactctgagactgtgatttcagctcctttgtcactggggagcgacccctgaggcaccgggagaggtgacctccctggcgccagtggaccaattattgcgtaggggactagccctctgggcacgccagggtgtggaacctgggagcacaatggcacctggtgaggcccaggaacctgggtttggtttgtaagcctgtgcctaagaggtagaaggggagcctgatcacctcctggagttgcccaagtggtctcacaagagacaaaaccgagactctaaggtactgggtagcgggctggagacattctgtgaatgtgagtgaataagactgatgacaggagagttccaactcgaccaagggccaaagcgagtgctgagtcctgatctgcagttctgtggtgatcctcacacggcttatggtggcccactttggagagatcctgacgttggggtttatacagtcccatcaatgctaagcggcacctgaaatatctccccctggaaaatggctggagacagatgaagcaattgtttactgcttccctttcccttcttgtgtgtgactgtcatcttttagggggaggaaatgggtggaaaacagagtaaacataccctgttagaatgtatgataaaaaatttcaagaagggatattcaggagattacggtattaagttgaccccaggaaaactccggaagttctgtgaaattgattggccgtcatttgggggtgggctagccctccgagggctcccttgacaaagagataatcagtagagtgtttggcgttatggtaggggaccctggccacccagaccaattttcttatataaacagttggcaagacctggtcctttcacaaccgccctgggtgaaggcctgtttagaggaaagttgaatgatgatggcttcttcaaaatgccaaccagaacctgaaaacaaccaggaaccagaagcaacccccccctccatatgccccattgtactctccactcccacttgtacttccagcagccagggccatgccagaggctactgcctcccctgagagcaccccctcccctgactcacccatgatgccaccagtcactgcctctcctgagcctccaaggttaactctgtatactccggtcaggaaggtgcccagaaagtcaggccggctggggcagcccctcttcaccacagtgccaggagcccctgcagatgccattgagagagaccagagagcctgtctattttctcaagaaagccaaattcaaggaggccaacgtgtttttgtgtaccaacccttcaccaccagtgatctcctaagctggaaaaatcatatcccctcttacacagagaagcctcaagctatgattgagctaatgcagtccatcattcaaactcacaagcccacctgaactgattgccgtcagcttctcctgactctgtttaacactgaagaacagcgccgaattactcaggcagctctaaaatggctagaggaaaacaccccggcacaaacactagatgcccaggcttatgcccgagaccatttcccaggggaagacccccggtgggaccctaatgtttaagggggacttccacaacttgcacgtgaccatgaggctctcctaaatggcatgaaacaaggtgggaaagggccatgaacatgagcaaaacctcagaggtactccagaggcctgatgaaagcccaagccaattctatgagagactatgcaaggcattccacctctataccccctttgacccagaagcagctgaaaaccagtggatggtcaatgcagcctttgtgagccaggcacaaggggacatccaatgcaagctccagaagttagagggctttgcaggaatgagtgctagtcagttgctgaagatagtaaccaaagtgtttgtcaaccgtgaccaggtggcactaaaggctgaaaacaaaaaaatgcaaaaaaaaaaaaggtgagcttactggcctctgctttggtgaagcaaatggaaggtgctccacaaagccaagaccgaggccagaaaggggagccatgaggaggaccatctcacccagggccaaagctgggacagaaccaatgtgcctactgtcaccaggaaggccattggaaaaaatgagtgcctccaattgtcagatgattcccaattgggccccaagcagaggggaagagaccaggtggtccagggccaatatcagccagcccagcagccgcactggggcccccaaaagtgattttgtagggctggccattatgggagactatgaggaggactaggactgaccgggctctattttgctaggcccccaagagcctatgggtccaaatgaatgtagggggctgggccattgacttcatggcagatactggggcagaacactcagtggtaactcagcctgtgggcccactattgcagagaaagccaccatcatagtggccacaggccactgaacacagcgccccctcctgctgcctagatgatgcactttggggagacatgaagtcatacatgaatttctgtacctccccaactgtcctgtgggcttaatgggctgagacctgttagaaaagctacaggcccagataactttcaactctcatggccaaatggccctgaccctagagaagctgagggcaaagatcatgacccttatgggcctccgaggagaagaatggcacctctacagtcttatagagaggccacggcaaagatctgagctccctacctggagtatgagctgaggacaaccccctgggactggccagaaacacacccccagtaatagtagaactaaaaccaggggtcgaacccgcctgccaacaacatttcattccctgcagagaatagggatccagaaacatctggagagacttctaaagtatggaatcctccaaccctgcaaatcatcttggaattcgcctctcctgccagttcaaaaaccaggaacagatgactaccagccagtccaggaactgcaagcagtaaaccaagccaccgttaccctatacctagtcgtccctaactcctatactctcctgggccaaatctccaccaaagctgccttctttacatgtctggacctgtaaagccgtcagctcaagatgccttcttctgcatctgtctggcccctccaagccaaccaatcttcgccttccaatgggaaaacccggaaaatggtgacaagggccagctgacctggactagactgtctcaaggattcaagaattctacagctatcttcggcaccacattggcctctgacttaaaagccttcccagcagaccagtatggctgtacactgctttaatatgtggatgacttactactggtcagacaagcccaggaaaattgtattgaagggacacgtctgctcctcaccctcctatgggaggctggctacaaggtttcaaagaaaaaggcccaaatctgtcaagaaaaagtcaaataccttggctttcacctatcccaaggacaacatcaactcagcccagagagaaagcaggctctctgctcgatcctggttccgtccacctgatgccaggttcgggaatttcttggggccataggtttctgtagaatctggatacccaacttctccattttggcaaagcccctttatgaggccataaaggggatagaatgggaatctctgttgtgggaatgtgtacaacaaaaggcctttgaagagatcaagaaggccctcaccagtgcacctggcctgggactcccagacatctccaagaccttgttcttgtacatgcatgaatgcactggtgtcacagtgggggtcctaactcaaatgttggggtcatggaatcatccagtagcatacctttccaagcgacttgactccattgcccaaggatggccaccctccctacaggcagttgtagccacagctctcttagtgtcagaattcatggtctgagtgccacactcagtactgacattaatgcaatgtaagggacaatactggctaactaatgcccagatggtcaaatatcagggaactgttatgtgaaaatccatgcattcacctggagatagtaagaaccttaaatcctgcaacccccgatgcctcgataccatgcaaactgatcatccaaaagaagcaagctgcagctccagagactgtgaggtagacagccctgctttagtcaccctggaagctgactaatctacacatggcagaaaagtgtgaagaatcggctagcagatgggataaatagactgcttttgtttcccatttcggttttcttactgggatgccctgccaccccccttttacctgttattgtgatccttgccctaatctttgccatagggttggcagagactgctctagccaaatggaactgtggcaaaagggttctgctagcattctctttcctcttgtggggagggtgttttgttcttattggttgctcctaacctgggccccttttgtacacttaaattccacccctgtgataaaggtatggaaaggatctggtatcaaggaaaggttggattgtccttcacctcctatacctatcagccagctgcttgttattgactaccacccccaccctttgcatgtataatggtaaaaggtactggatgggatggataaaaacaaaatacctagaggggcacacctgccagggaccaaagagaaggggaacaggaacttgggcctactgggcatatagtggacattgaggcatatccaatggagggggagttcaggatcatgtccgagcccagctagtcaaagaaactatacaaaggacaaagcaacaagcagatccaaggcctaagacacctccacaatcaggacctagcccagtctatgactaacttcggaaggacctgggtccagacctgaacttccccaccttaagaaaaaaccttttcattgatctggctgaaaggattgcccacgagttcaaagtcattaactgttgggtttgtggaggggcccttatgagtgaagaatggccttggaagggaaccagcataaacgcacttcatctacttcagtggaatctttccataacagagagggaaaacaactggccccaaagttgggtcttgacctcagaggtgtttggagaggaatgcattggtagaacaggacccaattacatacaatgggtaggagaaagtccacacaaaagaaagctgtcttagaactctaccagctttgagtggtggccaaacactccttcctggcactgggccctggcctccacagttaatacctcccagtgccaatcctctccctatcaagccatagtcaactgtactatacatactaaggaaggggccaatccattccaaggcatacctgaaattagtcaacattgggaaaacctcactcttagtgaccctgaacactggagggcacctgatgggctgttttggataagagcatatatgcaactcactgctcaaaggaaagtgagctgctccataggaataatccaacctagatttttcctcctgcctaatcaggaagtagaggaattaggggttcccctttatcagaacttaaagattagagcaagaaggatccctgagatgggggacaacaaaaatagagagaaaataaatgcccaccccagaggattatcgagacatatggtccagccacttgggcacaaggtgggagctggggctaccaaacccctatatatatatgcttaatcagatcattgggttagaggtggtactggaaattattactaaccaaacacccacaaccttagaattcatggcaaaacaacaacagcaaatgccagcagctatttaccagaaccgcctagccttggattacctattaccaaaagaaggaggggtatgtgaaaaatttaattaatcttactgttgcctccagatagatgataatggcaaggcaatggcaaacatagctacaaacatcagaaaaatggctcatgtccccatacaaacttggaaagactggaaccctgcagagctattcggggatggttttcaacctttggcgggggagtggtggtgggggggttcaaaatcctgtaggtattatgctcctgatcttgggaggctgcctgatcctcccctgtctagctctcctagttataaggtctgtctccagcctcactgaggccatggtaggggtggggggaggccacacatgtgatgatgttgtgagcatcaaagtggggaatgtgataggggttctcccaggacaatgggaaggcagcatggcacaaccagcatctgtgtgcccatgcaaatctgtggcagcatgacataatcaatatcgcacatgtgcacatgtgcaactatgtaacatggaccatccaatcagaatttacagaatgtgaataaggggaacaaagggaccaaaatgtaaaagggaaactagcagaggtatataaggcaaggccctgctgggttcagggctcagcctttggatatgaatccactgagccagtgccagcatgaataaatgctgcttcctggaaaaaagtctcagtgtccagtctctctgtatgagaattcagcaacaaatgtgttcaaagctcagaacataattggctaaaaaacaacttacatttgctttttggactttgagtaaaagatgaaaagaaattcattaatagcagattttagttctcttgttgcacagcaggataaggatctggtgttgtcactgcagattcagtccctggcctgggaacttctgcatgccacaggtaaggccaaaaaaaaaaaaaaaaaaggataatatttcagtttatttttaacagaggaggctcaattcctgactactttaacattggttaaagagcaataacacacatctgtcacaccattactgtcacttgtatgtggaaaagattcaagatcatctaagtgactgagagagctctgaccatctccactcacagccaggagtccagcaaagaagcatgacagagaaagtgggacttgccataaacttcttgagacggagcatgagccctatttgctgctgatccctgtgcccaggggcactggtagggttgaaagacacagctctgcagctgataaaggtctgccagccttcctgggttcttgatgaaactgaagtgaaaataacaggtagtgttttacagctgtaccctaaagtcacatttccttctcttcccctaatttctgcaaaaagagctaagtggacatgcctctggcaggtgtccttggatggacagtattaacataatagttcagatagggacattctggcaacaaaggaactcaccacaaagtaggtatattattaggcacctactttttgtctaaggcaacataaaaccaacataaaaaccaatgcaaccaataaaaatatgttttagttcctgggacagagagaaatatccaaccaagatggggagagggcaggaaagaggacaaagcaggaagcgaggagctgggctctgggttgaccctgttctgccaggctgcacttctctctgaaactctcctcctacatgaagttcatggtggccctggccttcaatgaatgagttactaatgttttcatctgaacagcaacttagatactttcccaagtgtctagaaacaaaccataccaaagattgggagattgaatccatacaacacagcaaaatttcttaaattcatatgtcctctcaatatttcaggtgaatccaaaatcccctcatgtcctcaacatgccaacgcttgcatcaaattggcaccagctggccagtcctttctctccagtcctttcaaattcaatcctcaccccacctactagagtagttccctgccctctccatgagtatgaaaatcacgtttgttctctctcctccttagctcccgcccagattctgctccagaggctcagaaaacagcctggaaaaaagaattctcctttaggatgggtcggtgagacgttggttagctcttctgctttcttatcatcttgggcctgattttctgaatttgctgggagacatctattcactcatgactagataagaggacctaaaagactaagatatgccaaagggcctatccttgaggacacttggtagctctgcactgtttgcagcctttatgtgcattttccccaattaccaggtatcaacaaacccaatataatttagaaccaacactgtcacaatgtgtctcagcaaacagtactctcctaagaaatggtcagggcttgctaaacattaaagaaaagaaagccaagatttaaaaaactggattcctgaaagggagtaaactataaactataaaatctgatgtgggtaccagaatcttatctatttaaagcttaatctgccactgtctggagcttagaagaaaaaagaagtacctgtccaaaatgacctttagactcgattagaatctctgaagctgccataagttttctctccgacaaggcaggtataaataacaacgttggatcttctttattaaattccttaagctggtgccctgcgggcctcagcattttcttctcttttcttttagggccgcacgaatccagtgtggcatactggggtcccaaggctaggaatgaaataggagcagcagccctaagccacagccacagccacgctggatcccagttgcgtgtgcgacctacaccacagctcacagcgacaccagatccctaacccactgaggccagggatccaacccgcatcctcattgctcctagtcgtgttccttaaccactgagccacgaaggcagctccccctcagcgttataatagcgcccgcctgtcctggtgaagaccgagtcagttacacccaccggcatagctctggtagggctcgatccagtatccagcccacatcgcgacatccttggggcacgtttacctttaaaaaagatcccagatttaatggacgctccagccaccacagcctcccaagacaacaccgacagagagaggctaaggtcaaagagtgctgcgccctagcccccgcaagccacgccccaaaccgcccgccacacctctaggctacgtccccaaacctgctcgttacacctcacagtccctgggcccccccgccaagcccctgaccacgccccaagcctgcgacctatacctcctagtcaggcctccaagccctggccacgcccggagaccacccgtcgcacttccaaacccgctagctacacttccaagccttgcccccagaccgcctgtcacaggtctcggccacgcccccccgcctggtcagccaatgcgagccccggcacatccgaccaggacacgctcacatgctagcctactctgggcaacccgagtggacaagctagaagctgtctgtaaggaaggctggtgccgcccggcggcaggaggacttggggattggagcctccttcaggagcgtggtcggcatggtcgcgcggggaggtgggggagggggctgtgtagctgagaaggttgctggtctgcctcagcgtggggagtgggaaaattaataaattaaaacctcacttaaggtggagtgggaagccccaaccgttcccccaacactggagaccatgcaggaaggaggtcgccaccttacttcccagcaggctaggtaggctgtctctgggtccggcgacaacccagccagccaatgggaagccgctacacttcccatgctcggctccctccaatgggctctgattctaacagccagccacgcccagctccccttcaccctatgaaagaatttcctctgctctgttctctggattggcctgtagtttgctaaagttgcgatttttttgctgatcattaataaacacatttttattatggtaaaataataagctgtcttctgttttatgtcaaggtgggggaagtggggtggagggtaactgtactcttgggcagggtctgcacattggcgtctgcatcgaagtttgcagctggcttctgcaaagagcagatctcaccctgaactgcagactgcctttttcctgggaaagtgggtggtggatgacgaaggcctgccctgcaactggaatctctggtattatcgctttttaaaaagatgaaatgttaagaacaggtaaaagatcacttaaagtcctctttagggaacactgatgcgtttcatccagtgtcgtggcttcacccgctgcctctactctgatggttctcaaatttttatctctggggactgctcgttgtggctcaatgaaatgaatctgactagcatccatgaagacgcaggttcaatccctggccttgctaagtgggttaaggatctggtgttgccatgagctgtggtgtaagtagctgacgtgacttggatccccgagtcactgtgcctgtggtgtaggccagcagctgcagctccaatttgagccctagcctgagaacctccatatgccttgggtgcagcccttaaaaaatatatatctacatagatgtatagatatatatatatataaaatctccagcccagaccttttctttggcagacctctcaaaccaacagctttcgttatccagatgctagtctccctagtcccctctcttccagccttccctctgcagtcctttcccctgtacacggtagcctagatgcgtgaaggacatagaaatctgacatctcaatcctcagcttgaagcccgtgggcagctcaccttgttcatgtggtaaagtataaaatcctaagcacagcctaaaaggctccattatctggcctgtctacccagcaaaccccttgggtacgctggtcattaaggctgcacaatgctacaaactgccaaggtcctggaccttgacttggtccccaactgcctggactgactccagcttttcccctagttctcacttatcttactgatccccatttcagtatcacatccttaagaaagcctatcctgagttcccgtcgtggcgcagtggttaacgaatccgactaggaaccatgaggttgcgggttcggtccctgcccttgctcagagggttaacgatccggcgttgccgtgggctgtggtgtaggttgca

SEQ ID NO: 48 - DNA, 7862 bp, Artificial
  ss216 sequence
tgctaatcaggtacccatcattgcttatcagttctgcttctgtaaccttgcccgctcagtttcttagggaggaagattgtctgcttggggatgggggaggtccaggatgcttacatggaaaaatcaagaccttgtagtgtataaagttactgaggacaaagacctggtgctcagactctggaggtgactcctctgagcctgcaccggtggtgaataaaccttgctgttccctatctctaagtgctgtttgtcttcttcctttgccacggtttttgcggtttccccaacattttggtgtgttggccgggaagccaacaaccaagctggcctcttgtgccaccattgtcggggaaccgggggaggccacggtcgctggcctggtgacaggtggatagcgcacaccggccattttgctggatccagaccctcactcgggccttggccttggcccacaccgcttcctgaacggactcagaaggagagtggaaacaggttcctggaaaggacggcagactgctgagtgccccggggacatctgcccaagtcaggaaccaccatacagcggaaggagagactgatcacctctcagtgaccaaagggtcactcaggtcagggtttgctcccttgggatcgggaggcttttcaattctggtgtgtgtgtgtgtgtgtgtgtgtgtgtgtgagtgactggagagaacgagagcccatgctccaccgtctttaggctacggagccagagtgagtcctaacctgcagttccacggcgaccctcatatgacttatggtggccctcttcggggggatcctgacattggggtttttacagtcccacctatgctaagaggtgcctgaaatatctcctccaggggagcggtcaggtggatgaaacgattgttacctgaggccttgtcctcattgtttgtcttgtgtcaccggcacagggtgggacttcacacaatgggtaaatcgacttccaagcccactgtcttaaagtgtatggttaagaattttaagaaaggattttctagagattatggtgttaagctgagtcttggaaaactgtgtaccctctgtaccctagagtggccctcctttggtgttggctggcctccaggagggaccttagatgtattcacagttgcagcagtatataatgttataacaggagaccctggacacccagacccatttctgtatattgatcaatggttggaaattgcctatttgaggcccccataggttcggttctgcaccacagaccagggacagtgtagggtgctagtagcccagtccaagaagaaaaccttgtctcaaaagaaggtgccacctatttatcaaggggaaccttaggacttgccccctatgccaccactttatgtgctgccagccccacctccaggagccgaaggtccccagatgccagatagcctactgccttctgtttctcctccttctgcttctgaagttcccgaggcgatatcacccccgcagccagattctccagaacctattatcaggcatctccattcagctcagggagcagccactccagcattaaaaatgcccttatgggagacacggggaccacagcaagtcgcccccaatgggaccatacaagaggggggacgtttttattattaccagcccttttccactgctgatctcctcaactggaaacaccatgcgccctcatattctgaaaagcctcaggcaccgattgatctcttagaattcattttccagacacactgtcccacctggatagactgccagcaactcctttttactctgtttgacactgaagagcactggcgaattggaacagaagcccaaaaatggcttcaggccatcgtggggggtcgagcagacttggcaaactgggtgagggaaggcttcccagaagaaaacccccactgggactatgacactgaagaagggaagcgtaacctagagaggtaccggcaggccttcctacagggggcaaaaactggggctaaaaagccccactaatatagctaagatcagtgagatactacaagagctgactgaaagcccagtcaaattctgtgagagactttgtgaagctttctgaacctacactccgtttgatcccgaggcccctgagaaccaatggatgataaatactgcctttgtgggacaagcccaatcagatatccataaaaagctacagatattaaaaggatttacaggagagaatgccactaaactgttggaaatagccaacaaggtttttattaaccaagaccaggtggcccgccatgatgcagaaaagaaaagaaaacaaaaagtggctcttctggcagccaccctgtcaaaactggtgcccccagtgggaccaccccataggggacaagacacaaggccagggaaaaggagtcccctggaacatgaccaatgtgcttactgcaaagaaaagggatattggaaaaatgaatgccccaaccgtcctgaaaaaaagaccaaggccccacctagctggtaccgatctgagccattcagcaccaacctgatcagccagctgagtctgattaggggggaccaggctctctccaactgggcccccaagagcttatggtcagaattcaagtagggggccaccccatagactttatggttaacacaggtgccaaactttctgtggttacacaacctgtggctcccctctcggggaaagaaaccaccattgttgaggccacaggtaaccaaaccacacagacccttctgcggtcctcgacgatgtcggataggaggccatgaagtaatacatgaatttctttacctgcctgactgcccagtccccctgatgggaagagacctgctggctaaaatgggggcacaaatttccttttctactgacggatcggcccaacttaaattgacagaacccccctctcctttaatcatggctcctgctgtaaaaagggaagaggaatggtgcttgtactcttccccttcagaaatggggaccattcccccagaactagagactaaatacccattggtttgggctgaaggaaacccgccaggactggcaaaacgccacactcctgtcttgattgatctaaaacccggagctcaaccaataaagctacggcaatactcaatttccagagaagctcgactgagaatccatgttcacctggatcggctgcttcaacatggactgttaataaaatgtcagtccccttggaactcccctttactgcccgtgaaaaaaaccgggaacacaggactaccgcccagtacaggtcttgagagccataaatgaaacaatggtcacattacacccgtctataccctgctagggctgatcccctccactgctgagtggtttacttgcctggacttaaaagatgcctttttctgcctccaggtggcacctgccagtcagcccttgtttgcttttaaatgggagaatccacatacagggacaaaggaacagctcacctggactagactcccacaaggattcaaaaactctcccactctttttagtggcaccttagctgctgacctagctgaatttcctggacaaaaactgggctgtgttttgctacagtatgttgacgacctcttactggctggcaccacagaggctcagtgcctagaaggaacaagagctctcctttccctactgatggaagcagggtatcgggtatgaaagaaaaaggcacaaatctgcaaaaaaacaagtcaagtatctgggcttcaacatcatgaagggctgacgaatgctggggactaaaaaaatgcaggcagattgtgccattcctgtccctaccacccgccggaaggtttgtgagttcccaggggcagcaggattctgccagatatggatccccagtttttcagacctggccaggcctctgtatggggctctaaaaggggaagaaaaggctccccttaaatggggaccaagccaggagacagcgtttcagacaatcaaaagtaaactcactgaggctccagccttgggacttcctgatataaccagagaatttaacctttttgttcaagaaaaaaatgggatggctttgggaatcttaactcaagaatttgggccttggcagaggccagtggcatatctgtctaaacaaattgactcagttgctgcaggatggcctccctgcctctgagtgctggcagctatcaccttgttgataagagaggctgacaagttgaccctgggactaaacctcaatgttaaagtcccacactcagttgtaaccctaatggataccaggggccaccattggctcacacatgcacgaatgactcaatatcaagggttactatgtaaaaatccacgggtaaaactggaggttgtacgaactctgtacacagccacctttctgccagatgaagcggggcccccagaccataactgcctggaggtactagatgagatgttttccagcaggcctgacttgactgataaaccactccaaaatcctgacttggttttatatactgatggcaacagctttatggaggatggaaaaaggatggcaggatatgctgtggtatctgacttcaaagtgatagaaacagaggtgcttcctcaaggctggtcagcacagagagcagaattatgggccttagtcagagcactggaattcagccaagaccagcgagttaatatctataccgactcatgatatgcctttgcaactttacatgtccatggagccttatataaaaaaagagggctcctcactgctgaaggaaaaggaattaaaaaccaggctgaaatcttaaagctcctagaggcagtatgaaaacctaaagaagttgcagttatccactgtaaaggccaccaaaagggggatgacccagtgacaaatgaaaaccatagtgctgatgtagctgccagacaggcagcccggggacaacagccagacaaacctaaggtcttgctggccccagaagtgccagctgtccccaaatattctccagaggaaaaaaaatggataagggaaaaagaggaactaaaactaaaacgggatggtgggtcacacaggaccaccgagtttacattccagaacaggtggcctacaaactagtcctccaagaacatgagctaacccacatgggcaaaactgccttagagaccctactgggctggtactatctcattgctcatcttcctgcactctgctcctctgtctcccaaagatgcataacctatttatagaataatgcccgccaggggccccacagaccagctggggcacagctctgcagactgtccccatttgaggtgacaaaagctttacagattcgatggaaactacactctgcttatcgccctcaaagttcagggaaagtagaacacatgaactgaacccttaaacagaccctgacaaagttatgtcaggaaactggcttgccctggatagacaggttgccggtggccctcttaaaagtgagatgctcaccctgagcgggaatagggttctcgcatttaaaatcttatatggaaggccacttccactaatcagtttaaaaagaaacaccagggagttgggaaacttggaattacataaacaattacaaggactgtggctcactatttctcagatacataaatgggtcacagacagaatacctgtgtccttaggtataacagtacacccccacaagccgggggaccaggtgtggataaaggcctggaaaaaggagcccttgaagcccctatggaagggcccctatactgtaattctaaccacccccaccgctcttaaagtaacaggaatagatgcttggatccatcattccagagttaaaccagctggcccagctgacaaccatggagagtgggagactgccctcgatccggacagacctctttgcctgacaatacagagaaggagacgtcgatctcaaagccctgctctgaccacaccggaagctggtcagtcaacgcacagctaaagcttgagaaaacggctgcctgtgagcccaaatggaaggagggtttcaaaataaacattcacattgacggaagaggccttgaccctggagctgtgctacatttccagagaatcacatttgcgctccaagctgcctctcacagtgtctttcattccttttataaagagataagaaacaccccacctcccattctggccacaactaagaacttgttcttagccctggcagaaactattgcacaaactctcaaggtctcctcttgttatatatgtgggggaacaaacacaggagaccactggccttggcaagccagaaaactgaacccattagagcctcataatgagactacatacccccaactcaccaatgggctatggctcctcaaaactgctattattggaaaaaattgtcttacgagttggggaggatggtttaatgtttcagttgaaagcctaacatgtttaggcctaagatattataatctgactgcccaaaagactcaatggtggtcatcctccaatctctcagagcccaaacctaatcccttgtctaacttttccctcctttgacaagcatgggaagatatcagtgctgatatccagtggcgggcaccaaagggattatattggatttgtaaaaaaaatggcctcttccatactcccccccaaattgggctgggacatgtgtactgggaacaatcagaccttccttcttcctgctcctactgtcactatgggagcaactgggaattcctatatataggatacagggtgccaaaagagaccagagggctctccaaattggagtctgggaagatgatgcccggcccccagaatggataattcaatattatggacctgccacctggacaaaggatggctctcggggatatcgcacccctatctatatgctgagccacatcctcagactacaggcggttttagaacttataacaaatgacactacaagggccttgactatattggcccaacaacaaactaaaatgcacagtacaatctaccaaaatcgcttggccttagattatttacttgcttctgaaggaggggtttgtggaaaatttaacttaagtaattgctgtctacaaatagatgacactggaaaggtggtaaaaaaaattgctgaccacatgactaaactagcccatgtacctgtacaaacttggaaaggataggatgcagacagtttctttggtaaatggttctcttggttgggaagaattaagacaatagtcaaaatagtcatggttatactcgcagagtgcctacttgttccctgccttatacctctcctgataaatattataaaaggttttataaaaaccatggttaaaaaaaaaaaacaaaaacaaacaaacaaaaaaaacaacctgccacctgctacttattagaggctatcaaaggttgtgactgatgataatctataaagggtgcagatgcaccctaaacatcaagagggggaaatgaaatggagttttaactaaagaacaacccccccttggctaacaaggcagctgcaagcctttccagctgtgctcatcactatgccacccttcttgtaataatgtaagaactgtgtgctctctgtccaagccagcagccctgctaattaggtacctagcattgcttatcagctctgcttctgtaaccttgcttgctcagtttcttagggaggaacactgtctgcttggggatgggggaggtctgggatgcttacatgggaaaatcaagaccttgtagtgtataaaagttactgagaacaaagacctggtgctcagaatctggaggtgactcctctgagcccgcaccagtgctgaataaaccttgtttttccatatctctgagtgctgtttgtctccttctgttgccacagtttttgcggtttccgca

SEQ ID NO: 49 - DNA, 7335 bp, Artificial
  ss220 sequence
tgcttctgtaaccttgcttgctcagtttcttagggaggaacactgtctgcttggggatgggggaggtctgggatgcttacatgggaaaatcaagaccttgtagtgtataaaagttactgagaacaaagacctggggctcagactctggaggtgactcctctgagcccgcaccggtgctgaataaaccttgcttttccatatctccaagtgctgtttgtctccttccgttgccacagtttttggggtttccacaacattttggtgcgttggccgggaagcggacaaccgagctggcctcttgtgccaccgttgtcggggaaccgggggaggccacggtcgccagcccagtgacaggtgggtagcgtgcactggccattttgccagatccagaccttcactcgggccatggccttggcccacaccgcttcctgaatggactcagaaggagagtggaaacaggttcctggacaggacatcagactgttgagtgccctggggatatctgcccaagtcaggacccaccatacagcagaaggagagactgatcagctctcagtgaccaaagggtcactcaggtcagggtttgctcccttgggatagggaggcttgtcaattctggtgtgtgtgtgtgtgtgtgtgtgtgtgtgtgtgtgtgtgtgtgtgtgagtgactggagagaacgagagcctgtgctccaccgtctttggactacggagccagagtgagtcctaacctgcagttccgtggcgaccctcatacagcttatggtggccctctttggggggatcctgacgttggggtttatatagtcccacctatgctaagaggcgcctgaaatatctcctctgggggagcggtcaggcggatgaagcgattgttacatgaggccttgccctcactgtttgtcttgcatcaccagcacagggtgggtcttcacacaatgggtaaatcggcttccaagcccactgtcttagagtatatggttaagaattttaagaaaggattttctagagattatggtgttaagctgagtcctggaaaactgtgtaccctctctaccctagagtggccctcctttggtgttggctggcctccagaagggaccttagatgtgttcacagttatagcagtatatgttgttataacaggagaccctgaacacccaaacccatttccgtatattgatcaatggttggaaattgcctatttgaggctcccatgggtttggttctgcaccacagaccagggacagtgtagggtgctagtagcccagcccaagaaaaaaaccttatctcaaaagaaggtgccacctatttatcaaggggaacctgaggactcgccccctatgccaccaccttatgtgctgctggccccacctccaggagctgaagatagcccaccaccttctgtttctcctcctctttctgcttctgaatttcccgagatgatatcacccccacagccagattctccagaacctatgagcaggcatctccggtcagctcagggagcagccactccagcattacaaatgcccttacgggagacacggggaccacagcaagtcacctccaatgggaccatacaagaggggggacgtttttattattaccagcccttttccactgccgatctcctcaactggaaacactatactacctcatattctgaaaagcctcaggcactgattgatctcttagaattcattttccagacacactgtcccacctggatagactgtcggcaactcctttttactctatttgacactgaagagcactggcaaattgtaacagaagcccaaaaatggcttcaggccaatgcaggggtcgagcagacttggcaaactgggtgagggaagccttcccagaagaaaacccccactgggactatgacactgaagaagggtaccagcaggccttcctacagggggcaaaagctggggctaaaaagcccactaatatagctaagatcagtgagatactacaagagccgaatgaaagcccagccaaattctatgagagactatgtgaggctttccgaacctacaccccttttgatcccgaggcccctgagaaccaacggatgataaatgctgcctttgtgggacaagcccaatcagatatccgtaaaaagctacagaaattagaaggctttgcaggagataatgccactaaactgttggaaatagccaacaaagtttttattaaccgagaccaggtggcctgctgtggtgcagaaaagagaatgaaacaaaaagtgactcttctggcagccgccctgtcaaaaccagtgcccccagtgggaccaccccgtaggggacaaggcacaaggccagggaaaaggagtcccctggaacatgaccaatgtgcgtactgcaaagaaaagggacattggaaaaatgaatgccccaaccgtcctgagaaaagaccaaggccccacctagccggtaccaatctgagccattcagcaccaacctgatcagcctagctgagtctgattaggggggaccaggctctctccaactgggcccctagagcctatggtcagaattcaagtagggggccaccccatagactttatggttgacacaggtgctgaactttctgtggttatacaacctgtggctcccctcggggaaagaaacaaccgttgttggggccacaggtaaccaaacacacaggcccttctgcagtcctcgacaatgtcagttaggaggccatgaagtaatacatgaatttcattacctaactgactgcccagtcccactgatgggaagagacctgctggctaacatggggacacaaatttccttttctactgatggatcagcccaacttaaattgacagaaccccctctcctttaatcatggctcttgctgtaaaaagggaagaggaatggcgcttgtactcttccccttcagaaatggggaccatccccccaaaactagagactaaatacccattggtttgggctgaaagaaacccactaggactggcaaaatgccacgctcctgtcttgattgatctaaaacccggagctcaaccggtaaagctatggcaatactcaattcccagagaagctcgactgggaatccaggttcaccttgataggctgcttcagcatggactgttaataaaatgtcaatccccttggaacacccctttactgcccgtgaaaaaaaacgggaacacaagactcccgcccagtataggacttgagagccataaatgaagcaacggtcacattacacccgtccgtccctaacccatataccctgctagggctgataccctccactgctgagtggtttacttgcctggacttaaaagacacttttttctgcctccgggtggcacctgccagtcagcccttgtttgcttttgaatgggagaatccacacacagggacaaaggaacagctcacctggactagactcccacaaggattcaaaaactctcccactctttttagcggcaccttagctgctgacctggctgaatttcctggacaaaaactgggctgtgttttgctacagtatgttgacgacctcttactagctggcaccacggaggctcagtgcctcgagggaacaagagctctcctttccctactgatggaggcagggtatcaggtatcaaagataaaggcacaaatctgcaaaaaacaagtgaagtatttgggcttcaacatcatgcagggccgacaaatgctggggactgaaagaaagcaggcagtttgtgccattcctgtccctaccacctgccggaatgttcatgagttcctaggggtagcaggattctgccggatatggatccccgggttttcagacctggccaggcctctgtatgaggctctaaaaggggaaggaaaggctccccttaaatggggaccaagccaggagatagcatttcagacaatcaaaactaaactcactgaggctccagccttgggacttcctgatgtaaccagagaatttaacctttttgttcatgagaaaaatgggatggctttgggagtcttaacgcaagaatttgggccttggcagaggccagtggcatatctgtctaaacaaattgactcagttgcagccagatggcctccctgtctctgaacactggcagctaccaccttgttggtgagagaggctgacaagttgaccctgggacaaaacctcaatgttaaagtcccacactcagttgtaaccctaatggataccaggggccaccattggctcacacatgcatgagtgactcaatatcaagggttactatgtgaaaatccacaggtaagactggaggttgtatgaactctgaacccagccacttttctgccagatgaagagaggccccacagaccagctggggcacagcactgtggactgtccccatttgaggatatggaagtggactttactgaggtcacccctagtaaggggtacaaatatttactagtttttatctgtactttttcaggatgggtagaggccttccctacccgaactgaaaagacaagggaagtaaccaaggcactcctgagagacattattcccagatatggaatgcctctgaccattgggtcagataatggactggcatttgtggctaaaacagtacaacagtaacaggagtagatgcttagatccatcattctagagtaaaaccggctggcacagctgacgaccgtggagagtgggagactgccctcgatctggagagacctcttcgcctgacaatacagagaaagagacaacaatctcaaagccctgctctgaccacaccggaagctggtcagtccacacatggctgaagcttgaggaatcggcagcctggtaaaataaactgccttacctcccttccacaagagactctctgtcatatactgttatcttatgaccaacatgtatgtttgctgcctgttgttgttaatctggtcccctttggttctgccaggatccatgtcctcatgtgacccatgcattcgagtgacctgatcagatcaaggggttacatggactttgctttactccactcatttctcctgttctggagaaattcatggaagttgtactcacaacaggaccacttattctatctgtcaacaggggggccaatatacttcctttgatccacgatactcaccaattgaggaatggttagaagtccggcgctctcataaatcagggcagctaattaatcagacccaaattaccaacaccaagttgccagtatcaatagtttttgatgcctgtgaagctatgaatgggtcatggacttctactagaccatgtggaagcccatcatgggaaagagaatataggatccaacataaatatatgtgctgggggaccacctggagcggttgcctggaatgcacttactggagcttgggtggcctgggcaacctggaataaggagacaaaacagctgtccttcaaaagggtacagcccctccagactgccagactaaagcttgtaacccagttaatttcactattttcaattccagtgggcccaaatggaaggagggtttcaaaataagcattcacattgacaggagaggccttgaccctggagctgtgctacatttccagagaaccatgtttgcactctaagctgcctctcacagcatctttcattccttttatgaagagataagaaacaccccacctcccattctggccacaattgagaacttgttcttagccctggcagaaactattgcacaaactctcaaggtctcctcttgttatgtatgtgggggaacgaacacaggagaccactggccttggcaagccagagaactggacccattagagcctcataatgagactgcatacccccaactcaccgatggggtatggctcctcaaaactgctattattgagagaaattgtcttgtgaggtggagaggatggtttaatgtttcagttggaagcctaacatgtttaaggcctaaggtattataatctgactgcccaaaagactcaatggtggtcatcctccaatcactcagagcccaagcctaatcccttgtctaactttccccaccttcgacaagcatggaaagatatcagtactaatatccagtggcgggcaccaaagggattatattggatttgtggaaaaatggcctattccatactcctcccaaattgggctggggcatgtgtactgggaacaatcagaccttccttcttcctgctcctgctgtcactaggggagcaactgggagttcctatatatagggcacagggtgcccagagataccagagggctctccaaattggagactagaaagatgatgaatggcccccagaaaggataattcaatattatggacctgccacctgggcagaggatggctcttggggatatcgcacccctatctatatgctgaaccacatcatcagactacaggtggttttggaacttataacaaatgacactgcaagggccttaactatattggcccaacaaaacaaactaaaatgcgcagtgcaatctaccaaaatcgcttggccttggattctttacttgcttctgaaggaggggtttgtggaaaatttaacttaagtaattgctgtctacaaatagatgacgctggaaaggtggtaaaagaaattgctgaccacgtgactaaacttgctcatgtacctgtacaaacttggaaaggatgggatgcagaaagtctctttggtaaatggttctcttggttgggaggaattaagacaatggtcggaatagtcatggttatactcgcagggtgcctacttgttcctgccttatacctctcctgataaatattataaaaggttttataagaaccatggttgaaagaaaaacagcctcccaccggctaccaaaaggttatgactgatgatgatctataaagggtgcagatgcaccctgaacatcagaggggggaatgaaatggagttttaactaaagaacaacccccccttggctaagaaggcagctgcatgcctttccagctgtgctcatcactataccacccttcttgtaataatgtaacaactgtgtgccctctgtccaagccagcagccctgctaatcaggtacccagcattgcttatcagttctgcttctgtaaccttgcttgctcagtttcttagggaggaacactgtctgcttggggatgggggaggtccgggatgcttacatgggaaaatcaagaccttgtagtgtataaaagttactgagaacaaagacctggggctcagactctggaggtgactcctctgagcccacaccggtgctgaataaaccttgcttttccatatctccgagtgctgtttgtctccttccgttgcca

SEQ ID NO: 50 - DNA, 10833 bp, Artificial
  ss465 sequence
tgagagttttggagttcccgtcgtggcgcagtggttaacgaatccgactaggaaccatgaggttgcgggttcggtccctgcccttgctcagtgggttaacaatccggcgttgccgtgagctgtggtgtaggttgcagatgcggctcggatcctgtgttgctgtggctctggtatgggctagtggctgcagctccgattcgacccctagcctgggaacctccatatgccacgggagcggcccaagaaatagcaaaaagacaaaaaaaaaaaaaaaagaattttaactaaagaacaaccccccctttgtctaaaaaggcagctgcaagcctttccagctatgctccccaccataccacccttcttgtaataatggaacaactgtgtgccctatgtccaagccagcagccctgctaatcagatacccagcattgcttatcagttccacttctgtaaccttgcttgctcattttcttagagaggaacactgtctgcttggggactgggggagtggggaggtcagggatgcttacatgggaaaatcaagacctggtaatgtataaaacttaccgagaacaaagacctggtgctcagactctggaggtgatgcctctgagtctgcactggtgctgaataaaccttgcttttccatatctccgcctgctgtttgtctccttccactgccacggtttttgcagtttctgcaacattgttggtgcatgggccgggaagccaacaaccgtgcgctagcctcttgtgccaccgatgttggggaaccgggggaggccacggtggccggcccggtgacaggtggatagcacgcactagccattttgctggatccagaccctcactcgggacgtgctggccttggctcacactgcttcccaaacggacttagaaggagagtggaaacaggttccaggacaggacatcggactggtgagtgccctggggacatctgcccgagtcaggacctgccatatggcagaaggagagacggatcacctctcagtgaccaaagggtcactcaggtcagggtttgctcccttggcatcgggaggcttgtcaattctggtgtgtgtgtgtgtgtgtgtgtgtgtgtgtgtgtgtgtgtgtgtgtctggagagaatgagagcctgtgctccaccatctttggaggatggagccagagtgagtcctaacctgcagttccatggcaaccctcctatggcttgtggtggccctctccagagggatcctgatgttggggtttctacagtcccatctatgctaagaggtgcctgaaatagcccctccaggggagtggtcaggcagacgaagggattgttacctgaggccttgtcctcgctgtttgtcttgcgtcaccgtcacagggcgggacttcacacaatgggtaaatcggcttccaagcccaccgtcttagagtgtatggttaagaattttaagaaaggattttctagagattatggtattaaactgagtcctggaaaactgtgtaccctctgtaccctggagtggcccctctttggtgttggctggccttcggaaggaaccttagatgtgttcacggttggatcagaatataatgttataacaggagaccctggacacccagaccaatttccatatattgatcaatggttggaaattgcctatttgaggcccccatgcgtttggttctgcaccacaggccagggacagtgtagggtgctagtggcccagtccaagaagaaaaccttgtcttgagaaaaggtgccacctatttttcaaggggaacctgaggactcgccccctgtgccacctccttatgtgctgtcggccccacctctgggagccgaaggtccccagatgccagatagcccactgccttctgtttctcctcctcctcctcctcctcctcatgctcctgaagttcccaaggcaatatcacccccaccgccagattcaccagaaccaatgagcaggtgtctccagtcagcccagggagctgccactccagcattgcaaatgcccttaagggagacacggggaccacggcaagccacccccgatgggaccatacaggaggggggatgggttttattattaccagcccttttccactgccaatctccttaactggaaacaccatactccctcatattctgaaaagcctcaggcgctgattgatctcttagaattcattttccagatgcactgtcccacctggatagactgccggcaacttctttttactctgtttgacactgaagagcgctggtgaattgtaacagaagcccagaaatgacttcaggccaatgcggggggtcgagcagacttggcaaactgggtgagggaagccttcccagaagaaaacccccactgggactatgacactgaggaagggaaacgtaacctagagaggtaccggcaggccttcctacagggggcaaaagctgggggtaacaagcccactaatatagctaagatcagtgagatactacaagagccgaatgaaagcccagccaaattctatgaactatgtgagcctttccgaatttacaacccttttgattccgaggccccggaaaaccaacggatgataaatgctgcctttgtgggacaagcccaatcagatatccgtaaaaagctaaagaaattagaaggctttgcaggaaagaatgctacagaactgttggaaatagccaagaaggtttttattaaccgagaccaggtggcccgccatggtgcaaaaaagagaatgaaacaaaaagtgacacttctggtggccgccgtgtcaaaaccggtgcccccagcaggaccaccccataggggacaaggcgcaaggccagggaaaaggagtcccctggaacatgtccaaagcgcttactgcaaagaaaagggacattggaaaaatgaatgccccaaccatcctgagaaaaagaccaaggccccccctagccggtactgatctgagccattcagcaccaacctgattggcctaactgagtctgatttggggggacccgtctccctccaacagggcccccgagagcctctggccaccccatagactttatggtagacacaggtgccaaaccaccatcgttggggccacaggtgaccaaactcacaggcccctctgtggtccctggtgatgccgattaggaggccatgaagtaatacatgaatttctttacctgcctgactgcccagtctccttgatgggaagagatctgctggttaaaatgggggcacaaatttccttttctaccgacagatcggccccactcaaattgacagaaccccccagtgctttcatcatggctcttgctgtagaaagggaagaggaatgtcgcttgtactcttccccttcagagatggggaccattcccccagaactagagactaaatacccgtgggtttgggctgaaggaaacccaccaggactggcaaaatgccatgctgctatcttgattgatctaaaacccagagctcaaccagcaaagctctggcactactcaattcccagaggagctcgaccgggaatccaggttcacctggctaggctgcttcagcacggactgttaataaaatgtcagtccccttggaacacccctttacttcctgtaaaaaaaaaaaccaggaacacaagactaccacccagttcaggacttaagagccataaatgaagcaacagtcacatcacagccatccgtccctaacccgtataccctgctaagtctgatcccctccactgctgagtggcttacttgcctggtcttaaaagatgcatttttctgcctctgggtggtgcctgccagtcagcccttgtttgcctttgaatgggaaaatccacatacggggacaaaggaacagctcacctggaggagactcccacagggattcaaaaactctcccactcctttagcggtgccctagccactgacctggctgaatttcctggacaaaaactgggctgcgttttgctgcagtacattgatgacctcttaccagctggcaccacggaggctcagttcctagagggaacaaaagctctcctttccctactgatggaggcagggtatcgggtatcaaagaaaaaggcacaaatgtgtaaaaaacaagtcaagtatctgggctttaacatcatgcagggccgatgaaggctggggaaccgaaagaaagcaggcagttggtgccattcctgtccctaccacccgccagaaggttcgtgagttcctaggggcagcaggattctgccggatatggatccccgggttttcagacctggccaggcctctgtatgaagctctaaaaggggaagaaaaggctccccttgaatggggaccaagccaggaggcagcatttcagacaatcaaaaccaaactcaccgaggctacagccttgggacttcctgatgtaaccagagaatttaaccttcttgttcatgagaaaaatggaatggctttgggagtcttaactcaagcatttgggccttggcataggccagtggcatatctatctaaacaaattgactcagctgcagctggatggcctccctgcctccaagcgctggcagctaccaccttgttggtgagagaggctgacaagttgactctgggacaaaaccgcaatgttaaagtcccacactcagttgtaaccctaatggatactaggggccaccactggctcacacatgcacgaatgactcactatcaagggttactatgtgaaaatccacgggtaaaactggaggttgtacgaactctgaacccagccacttttgtgccagatgaagcagggcccccagaccataactgcttggaggtactagatgaggtgttttccagcaggcctgacttgactgataaaccactccaagatcctgacctggttttatatactgacggcagcagctttatggaggatggaaaaaggatggcaggatgtgctgtggtatctgacttaaaagtgatagaagcagaggtgcttcctcaaggctggtcagcacagagagcagaattatgggccttaggagttcccgtcgtggcgcagtggttgacgaatccgactaggaaccatgaggttgcgggttcagaccctgcccttgctcagtgggttgacgatccggcgttgacttgagctgtggtgtaggttgcagacatggctcagatcctgcattgctgtggctctggcgtaggctggtggctacagctccaattcgacccctagcctgggaacctccatatgctgtgggagcggcccaagaaatagctaaaaagacaaaaaaaaaaaaaaattatgggccttaatcagagcgttggagctcagccgagaccagcgagttaatatctataccgactcacggtatgcctttgcaactttacatgtccacagagccttatataaagaaagaggactccccactgctgaaggaaaagggattaaaaaccaggctgaaatcttaaagcttctagaggcagttacccactgtaaaggccaccaaaagggagatgacccagtgacaaaaggaaacaatagtgcagatgcagctgccagacaggcagcccggggacaacagccagacaaacctaaggtcttgctggccccagaagtgccagctttccccagatattctccagaggaagaaaaatggataagggaggaaggaggaactaaaactaagacgggatgctgggtcacacaggaccgctgagtttacattccagaacagctggcctacaaactagtccaccaacaacacaaactaacccacatgggcaaacctgccttagagaccttactgggccggtactatctcattgctcgtcttcctgcactctgcttctctgtctcccaaagatgcataacctgtttgcagaataatgcccgccagggaccccacagaccagctggggcccaacactgtggactgtccccatttgaggatatggaagtggactttactgaggtcacccctagtaaggggtacaaatatttactagtttttatctgtactttctcaggatgggtagaagccttccctacccaaactgaaaaggcaagggaagtaaccaaggcactcctgagagacgttattcccagatatggaatgcctctgaccattgggtcagataacgggctggcatttgtggccgagacagtacaacaggtggcaaaagccttacagatctgatggatactacattctgcttatcgccctcaaagttcagggaaagtagaatgcatgaaccggacccctaaacagacactggcgaagttatgtcaggaaactggcttgccctgggtagacaggttgctggtggccctcctaaaagtgagatgttcaccccaagtgggaataggattctagccatttgaaatcttatatgggggggccaccgccactgatcaatttaagaggaaataccagggagttgggagacttgaaattacataaacaattacaaggactggggctcactatttctcagatacataaatgggtcacagatagaatacctgtgtccttaggtataacagttcacccccacaagccaggggaccaggtgtggataaaggactggaaaaaggagcctttgaggctggtatggaagagcctctatactctaattctaaccacccccactgctctttttttttggcatttcttgggccgctcccgtggcatatggaggtttccaggctaggggtctaatcggagctgtagccaccagcctatgccagaggcacagcaacgcaggatccaagccgcgtctgcaacctacatcacagctcacagcaatgccggatcgttaacccactgagcaagggcagggaccgaaccctcaacctcatggttcctagtcggattcgttaaccactgcgccacgacgggaactccccccactgctcttaaagtaacaggaatccatccttggatccatccttccagagttaaaccggctggcccagctgacgaccatggagagtgggagactgccctccatccagagagacctctacacctgacaatacagaggaggtgacaacgatctcaaagccctgctctgaccacactggaagctggtcagtcaatgcacagctaaagcttgaggaatcggctgcccagtaaaataaactgccttaccttccacaagacacttgcttactgttatatactgttatcttatgaccaacatgtatgtttgctgcctgttgctgttaatttggtcccctttggctctgccagattccatttcctcatgtgacccatgcattcgagtcatccaatcagatcaaggtgttacatggactttgctttactccactcatttctcctgttgcagagaaattcacggaagttgtactcacaacaggaccacttattctatctgtcaacagagggaccaatatacttgctttgatccacgatactcaccaactgaggaatggttagaggtccagcggtttcataaatcagggcaactaattaatcagacccaaatcaccaaccccacattgccagtatcaatcctttttcatgcctgtgaagctatgaatgggtcgtgagcttctaccagaccatgtggaggccagtcatgggagagagaatatagactccaagacaaatatatgtgctgagggaccacctggagcggttgccagcaatgcacttcctggagctgcgtggcctgggcaacctgggataagggagacaaaacagctttccttcaaaagggtacagcccctccaggctgtcagactaaaacttgtaatccagttaatttcactattttcaattccagtgagcccaaatggaaggagggttgcaaaatgagcattcgcattaatggaagagaccttaaccctggagcgctgctacatttccagagaatcacatttgtgctccaagctgcctctcacagggtctttcattccttttatgaagagataaaaaaaaaaaaaccaccccacctcccattccggccacaacctaagaacgtgttcttagccctggtggaaactattgcacaaactctcaaggtctcctcttgttatgtatgcaggggaacgaacacaggagaccactgcccttggcaagccagagaactggacccattagagcctcatagtgagactgcatacccccaactcaccaatggggtgtggctcctcagaactgccattatagggagaaattgtcttgcgaggcagggaggatggttcagttggaagcctaacatgtttaggcctaaggttttataatctgactgccccaaagactcctccaacctctcagagcccaagcctaatcccctgtccaacttttcccacctccaacaagcatgggaagatatcagtgctaatatccaatgacgggcaccgaagggattatattggatttgtgggaaaatggcctattccttactcccccccaattgggctggggcatgtgtacagggaacaatcagaccttccttcttcctgctcctgctgtcactaggggagcaactgggagttcttatgtagagggcacagggtgcccagagagaccagagggctctccacattggagactggaaagatgatgaatggccaccagaatggataattcaatatcatgggcctgccacctgggcagaggatggctcttggggatatcgcacccctatctatatgctgaaccacaccagcagactacaggtggttttggaacttataacaaatgacactgcaagggccttgagtatattagcccaacaacaaactaaaatgcacagtgcaatctaccaaaatcacttggccttggattatttacttgctgcggaaggaggggtttgtggaaaatttgacttaagtaagtgctgtctacaaatagatgataccggaaaggagacagaagaaattgctgaccccatgactaaacttgcccatgtgcctgcacaaacttggaaaggatgggatacagactgtctctttggtaaatggttttcttggttgggaggaattaagacaatggccagaataattgtggtgatactcgcaaggtgcctacttcttccctgccttgtacctctcctgctttttgttttgttttgtttttgctttttagggccgcacctgtggcatatgaaagttcccaggctagaggtcgaatcagagctacagctgccagcctacaccacagccacagcaacacgggctctgagccatgtctgcaacctacaccacagctcacagcaatgctggatctttaaccccctgagcaaggccagggatcgaacccgcatcctcatgggtcttagtcaggttctttaaccactgagccatgaagggaactccccatctcagtatttttttaatctcctttccactttcttctttactctttggttgcttaaatgtgtgttgtttaatttctgtgtatttgtccattttccagttctttctgctacttatttctaagttcattgcattgtaatcagagaaaatactttgcatgatttcaatctttcaaaacttatggatttttggttttgagcttcatatatattcctgtctggagaatactgcccatgagcttgacaagcatgtatgctctgctatcatcaggtagagagttctatatttgtctgtgagcactagcagtttgtagcattgctcaagtcctctatttccctacagtacttctgcctagatgtttgatccattactagaaccaaggtatcaaagttttcagctagaaatacagaactgctttttctttaattatttcaatggttgcttcatatatttgggtgctcttctttgatgcaaattttatcccttttttttttctttggtttttttgtccttttagggccacacttgcagcatatggaggttcccaggctaggggtcgaatcggagctattgctgccagcctacaccacagccacagcaatgcaggatccaagccgcatctttgacctacactgcacctcacggcaatgccggatccttaacccactgagtgaggccagggattgaacctgcaacctcatcgttcctagtcggattcgttaaccactgcgccatgacaggaactccttaactcattatttctaatgagaactagtacattctctgcattttattggcaatcttttatatgtgactatttacttttttgctttcaatattccatctctggcttatataagattgattacaatagatctaggtgtggaattaatcaatcatacaataaacagagagaaaaagaacccttctcagagttccacaatcacttgtgagaagaatcactcatcaaactaaaaataaaagacaatttcctcagccttattaagaatagctgcaaacatcacacacctaacatcaggcttaagaagcctcaatgtactctctctctgatcagaaacaaatcatggatgttatctcttgttatttctatttagccactatacttcaggtattagttactataagacagaagaaataaagacatacaaattgaaaaggaggaaataatattctctccttccttgatgaatgtataatcatgtagtaaaaatcccaaggaatccaaactggctttactagaaacaatttaaaaatttagcagttttcagagttcctgttgtggctcagcagaaatgaatccaactaggaaccatgaggttgtgagttcaatccctggccttgctcagtgggttaaggatctggcactgccatgagctgtggtgtaggtcacagatgcggctcagatcctgagttgctgtggctgtggtgtaggctggcagctgtagctctgattcaacccctagcctgggaacctccatatgcca

SEQ ID NO: 51 - DNA, 5407 bp, Artificial
  ss292 sequence
  misc_feature (3262)..(3262): n is a, c, g, or t
  misc_feature (3327)..(3327): n is a, c, g, or t
  misc_feature (3337)..(3337): n is a, c, g, or t
  misc_feature (3360)..(3459): n is a, c, g, or t
  misc_feature (3461)..(3461): n is a, c, g, or t
  misc_feature (3463)..(3463): n is a, c, g, or t
  misc_feature (3490)..(3490): n is a, c, g, or t
  misc_feature (3501)..(3502): n is a, c, g, or t
  misc_feature (3512)..(3512): n is a, c, g, or t
  misc_feature (3521)..(3521): n is a, c, g, or t
gagcctcccggcctcccacaaaggatgctggctgcttctcccatcgccagcccccttcccccctcctcagcccccaggtccacacagaggttgtcagcacaggctgaaaggcagcttgttggccctgatgctacagtagccatggttgccagcaggtcagtaccagcgctggctgtgctgctgaccatcagctcatgtatggcgtggactttcgcctctgactcatcagcctggaaagtctttgctgccatgtagagcttctagagtgggaaaggtagggctgggtaccgaacccagcctgggtggcatgtatgggtcagcctctggcagacggagagaagaatcaggtggggaagtacacttggcttcagacacctctctggcctttggtgggcatgtagggcatgcgtttagagagctggcacaaggggaactgcaggctagagtcagacccgtgactttgatgctatgcaggtgttttctaggcatgacctactccatggtttctgtcttcaggatcctggtcacatgggagccaggctgttataacctcggctctgcctctagctgtgtgatgttgatgtattgaactctcctggagaccactgaagagctgaactctgggagttcccatcatggcgcagtggttaacgaatccgactaggaaccacgaggtttcgggttcggtccctgcccttgctcagtgggttaacggtccagcgttgccgtgagctgtggtgtaggttgcagacgtggctcagatcccacgttgctgtggctctggtgtaggccggtggctacagctccgattcgacccctagcctgggaacctccatatgcctcgggagcggcccaagaaatgacaaaaagacaaaaaaaaaaaaagagctgaactctgcagaaggcaaatatctgtggacgcagccttctaagtacagggtctccttcaaagacaagataaggggctaatgcattaaccatgttattctataaacagctgcattaaagtcctaagtgtacgcccctttgatatcactgagaagataacctcgtcattgcctatgcctgttcttgcccactaatcttgtcaccttccttaataaaagtcacctaggtgcctttgttctgtggaacagagtgcctcctggtcccccactttccaggcgtagaagagtcttgtgtgtttcattgtaccgcgctgtccttcttccaggatgccctatttccctgcagctctggatgcagcagagtggcgcccaatgcggggctggaggagaaggtctgccacgagcaggaaaaagtgaaactacagacggcagacacggtaggtagccttgcccttgacggagtcgcgactgtgaataggcaagtagaaactttaaaccacgataacaatggggcggaatcacaggaaacgaaacgttatattcgattgtttaaatgtacgctgacacagtcagaggctcgggtaatagaatctgagataaaggaattgttagaagccttgattcaatataacccttggtttccagacgtggaaagttgggatctcatggaacaaagtttaaaccacgcccgtcagtctggggcctctcttcctgtttctgttttttctacatgaggactggtaagacatgttctagaacgcttgcaggagcataaagaaaaacctatgccttctgctcccccgcccagactgatccctttcttgatgagagtttaaataagcctttagctgtggaggcaacactgactccccttcaatcagccctaaaatctgctcatctagaagactggacctttttagcatgccctgtaattatggtccccaatcctccagtcccaggacaaaatatccatacacataaaccttttgattttaaggctcttaaagctcttcaggaaattgtactacagaatgaagcttacagctccctttgctatgaatgtgctggaaagcaaggggacacttcagcttcccccaggggattgacatatggcagccagagcctagatggtggagactatttaatttggaagtctagtctttcagatttttgtcaggaacaggctcacttaaatcaaagcaacaatgttccaattacttttgaaatgttagttgggacgggcccttttcttgacttagcaaagcaactaaggcataatggaatactcctacttttactatccccccaaaatcaggtaaatggaggctgttgcattatttcagaaaaattaaataaaaaaacaacgtacactatgggagccttacaaacctatgacttgccttctcctactgcaattcccttagactgggctttaattgttacagatttaaaggattgtatttcaccataccttatcccctcaagataaatgtagatttgctttctctgttcctgcattaaataataaagcacctatgaaatgatatcagtggaaagtgttgccgcagggcatgaaaacagccctaccatgtgccaagaatttgtggatcaagccttagcacctgttagacttaaataccctgaggcatatattattcactacatggatgatattctcttctctgatccaaaagaccaacacgtttttaacatcttgctagataccaaagtatgtcttaataaaagggggcttattacagccccagataaaattcaaaaaacccctccatttcaacatttagcaacttcgataaaagtctgtactattcggccacagaaaaaatgcaaattttcaaggaccaattgaatacattaaatgattttcaaaaattattgggagatattaattggctatgaccttatttagaaattactacaaatcaattaactcatctttttaaaacactgaagggcgaacctgaccttacctccccacataccttgtctcctgcagccctcaaagaattatagctggtttatgaaaaaataaatgaggcacagttgcaacgtactgattatgataatcttatttatcctgatatgttgccttccatcaattcacctagagcagtcctagttcaggaaatgccacagtttggcattgtcaaatggatccatctttctagtcaagaagtaaaaacagcaacactttctgtggatcttagagccaaaactattatccaaggcagactcatcctaaacaattgatcggagcagatccaaatgttatacatgcccctctagacaaatttatgagagaaactttcttccaaacctcatggccatggcagactgctttagctggatatggaggngaactttgatatcacgcaccccaaaataaatctataaacttctacagagaccctctttgtatccnagaagtcacnatcacagcctattgccaagctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncntncatcattcactagagcatctagtcagnaaatgcacagnnttgcatgtcnaaatggatncatcttctagtcaagaagtaaaaacagcaacacttctgtgggatcttagagccaaactatttatccaaggcagactcatcctaaacaatgatcgggagcagatccaaatgttatacatgcccctctagacaaatttatgagagaaactttcttccaaacctcatggccatggcagactgctttagctggatatggaggggaacttgataatcacgcaccccaaaataatcttataactttcctacaagagacctcttttgtattcccagaagtcaccaatcacagcctattgccaaagctcttattttacagacggatcttcaaatggtgaagctggtttctgaggtccaaatattattaaaattatacaaacctcttacacttctgctcaaaaagcagaaccagtggcttgttcaacaagttttaaaaatagtcttgtatccttgtaatattgtttcagattctcaaaatgtggtacaattagtacaaaaacatggaaagaactaaatgatgaagggttatttcaactgttttttttttgcccacaacaaattattagacagaagacatcactatttttttttttgtctttttgccttttttctggcctacagcagagacacagcaacacaggatctgagacgcgtctgcgacctacaccacagctcacggcaacaccagagccttaacccactgagcaaggccagggattgaacccacaaccccatggttcctagttggactgagccacgacgggaactccgacgtcactattttttatgactcatatacattctcatacttctataccaggtcctttacatgatggaaatcaaaaggtaaactggcttataactttttttttgtcttttaggactgcacccggggaggttcctatgcccaggaacctcccctgggcatatggaggttcccaggcttggagtctaattggagctacagctgccggcctacaccagagccacagtaacgtgggatctgagccgcatctgtgacctacaccacagctcacggcaacgccggatccttaatccactgagcaaggccagggatcgaacccgtttctagttggattcgtttctgctgcgccccaaggggaactcctataacttctatttatgaaactgctcttgcttcacgtgtacttctccaccaacccgcggcaatgtggtgtagacagtttagtctgtcttgcatggttgcccaagatattattaaatcctgtccatcgcgtcaaagcttagcccaggtgtctaccaatgacagagtcgatcccggaggactaaaaagtaatcaactatggcaaatggatattactcacattaatggtttcggtcgcttcaagtctgttcgtgttatggttgacacatattcctctgttcactttttgacatgtccaaaaccattgttcgggagttcccgtcgtttcgcagcggttaacgaatccgactaggaaccatgaggttgcaggttcgatccctggccttgctcagtgggttaacgatccggcgttgccatgagctgtggtgtaggttgcagacgcggctcagatcctgcgttgctgtgtctctggcgtaggccggcggctacagctccgattagacccctagcctgggaacctccatatgccaagggagcggcccaagaaatggcaaaaaggcaaaaaaacaaaaaacaaaacaaaacaaaaaaaccattgtttggaagcttttgctgtttgggtcttccacaaagtattaaaactgataatggatctgcttatgctagtaaggcttttgctgagttttgttaaattgggtattttacatgtccctggcatcccttataatcctcaggaataaactacagtagaacgtgcacatgacaaa

SEQ ID NO: 52 - DNA, 8177 bp, Artificial
  ss371 sequence
cttcctcccccttatctttcctctatctctgactttgatcctatcaatgcctcagcctcccccttcaatccctcataaccataatcctcctcctccccctcccgccatttctgtgcttccagctcctacagcccctacaccttcttctcccactcccgcaattattcttcctcctcctccttcctgcccccagaatctcaattcccctcccatgcagccccctcccatagtaacaaccccttttatccccaccccaccctgcaatgagatctcaatcagcaataatccctgaggccccaatccttcctttaagagaggttgaagaaactgaaggaatagtcagtgttcatgtgtctttttctttggtagatttatcccaaatagaaaaatgcttaggttccttcacctcagacccaactacttacacaaaagagttctaatttcttattcactcctgtgacttaactcggcatgatatttatgttatctttagctctactctctccaccaaagggaacaaatttggctggcagcccaagctcatgcagacaccttacatactcaagatcccactaacacacttgcacactttttaacaccaatttttgccacttattcctagttattcccacatgtccaacccctatgataggtgcccacagaactgtgcccacagaacaaactgtgcccactcatgatcctgttggaactctagctgttcctcatgtggaccctaattgtaactatcaggtggactccccaggaagatgcaagagaggccaccttatctcttacctaatgtaaggaatgaagaagtcctcattaaaaatagttaattatgataaaattagagaaataatagaagaactccaaaaaaaaaaaaaatccaacacttttatgtccaggcttacagagactattcttaagtatactgccccaaatctagacagtgaagaaggaaaaaaaaatatctctatatgcatttcatttcccaatcagcatcagatataaagaaaaaaaaattacaaaaactagaggatgatcctctgaccccacaaagtgacctcattaaagctgcctttaaggtttttaacaatagagaagaagaacaaaaggttcaaaaactaaaggagtccatgacaaataatagggaaatcaaaaacaagaccatggacctccccgctgctgtctcccaaggcatataaacttagagaacagcttcccctctgggggcctgtttccaacatggcttggaggggcattgggcaaataaatgccctaaccccaaacttccttcaggcccttgtcctaaatgcagtcaaactggacattggcagggaaactgtgggaagccagggcaccccactgtcccccccacaaaacccaccttggagaccaatgacatgcactacctgttgggccaggccatggaagagtgatggtgcccaaggccaccaggcctccaccttcccaccaccactctggagcctctggtatctatgcagtagcaggtaagactgtttcatgcttactggacatgggagcatcatactcagcattacctagtttccagggtacacccccccacttttataacagggttaaatgggttgcccacgacatcccaaaagaccagagacctttagtttgcacactttttaacaccagtttttgccactcattcctacttattcccacatgtccaacccctacaataggttccaagttccaagcatatattcaatttcctacacaaccaaacacaaagttcctaccactgcgccagccagatttggggcccactcttcccagtccttcccacctcccctccgatgtaaatcccattgattggaataccactatgccaaggtatttccattctcataagactaaaggatcctactaaatttcctaaccaacctcaatatcctattatcccagaagctcagaggggactaaagcctataattcaatgcctccttatggctaatgttctcaaatacttactctccattcaacactcctatccttcctgtaaaaaaaacagatcaatccttctgattagttcaggatcttcacctcatcacacaggcaattctttccattcacccattggtcccaaatctctcctgtctcatatacctcctaacacttctcatttcttggttctttgacataaaagaaaccttttttacaatccctctagaccctgcattccaggacttatttgctttcatatggactgaccccaccactctttcagcctctcagttaacctggacggtccttcctgagggttttagagacagcccacatttctttggctaagacttagccacaaatattaaccgctcaggatagctgaggaccaacttgtccactgacgaaccagacccagtggccataactgggacccctttagttcccggtttcctcctgatggggacaatgggccagagtgccccgaccaggtaagggacaagagactttgttgacgttttcccctcccctctcccttttctcttttcaaactcaagctgtcctcttttcctcctcttgaaacctgtgaagatccaagacatttccatttactcttttttgcataaacaatttttaaaaagcaagcttgagaaaattctcttcagaattctgaccttgagggagtaagtcctgggagaacttttctcaccctgtgccttgagacctggctctgaggaacacctatcttatctagaccatctctaattcctgagactgaaggaaaaaaaaggggggggagggaaagatgcttttcaaacctatttataaactagtgagttttatttgcaacatctgactcatgactaagcttagaaaatgaagctatgggatctctgtgtctgtctatgggtttgtatgtgcatcatatatgtcttaatttggggatggtattatcaaagtttaaatgtaaatgagccctacttaattggcttaaaggaagttaagtgcatatataaattgtcaaaatatgaaagggaattaacttgtcagaattaattttaggttctcaagaactgggaagtattcagtattaaattaatatcttgtattaaagttagtttgttaattggattaatatagacatgactttagagttataaacattaagtataacatcttactgtatctagttttaatagaagtcaaatgagatactgagacatcaattactaaacaaaacctaaaggtatttaggactattaatcaaattattggtgccatgtttttctccataagaaaaacatgtttgtttgtttgtttttcataaaagacagtccatgattgctttagaaaattaggatttgtgtgttttcaataaagaaagaatgaggaatggaactgcattttattaagggaaaagaaagcaagtttgtcttgtagcttgttgctttggatggaaaaataagggacagactagtatggatacagaaagtgatggaaattttgtgggaagcggacacagagaaaataattttgtgaagagttgggactaagttcagaataaatttaatgaatacattaattttaaaagcaagctggtacaaaacttgaatttagcttttctctccttgctaagagcacagagtcttcttggaatgctacttttgtcaacagattatgtgaagtcctttgtatttaagagatctgtatttgcttttgagatctttgtaactttgggaaaagtattatccacagtgacctataattctgtctgaatgtttttaatgaactttctatcaaattctaatataagttttgttttttgtttttttttttttacttcagcgaactttggaatgatttagaggcatcccagaggtgggggagaaggagagttaaattaactaggaaaatacatggagagcattatcaaatgagtgataagcctcctcagattatatagtatgctgtctcaactataaccaagtttctttgtcaactgttttgtaatcagatcttaaatgtgccttcttaagtctttcgtcactataggcagttaatggctctactctgaggcctttgcaaaaaaatcctttctcttcaagggttttttggaaaatacaagtttcctgattatcagatcataatgctgaactaggttcttatactggactggtttgtagagaggactactgacaaaatcatgctcacatggaagaaaaactataccaggatgagaagaagacatcagaagtagatagctggcccaagatcctggacctgactcaaaaccatcaaatcacagacaaatgggtcaactctattctggccttacagacgtacagataccaccaattccttccacctccccccaccccctaattgatgcccctgttcagcaggaagaagctacagaaaaagagacctttgccccttttcctattaaaaacagagatgactctgctgatgccacagcaatgccagatccaagctgcatctgtgacccacaccacagctcccagcaatgctggatccttagcccactgagtgaagccagggatcgaacccacaacctcatggttccagttggattcgtttctgctgcgccacaacgggaactccaacaccaagtactttggttccttgctgacgtgccccagcctgagagaagattgtaagactggactctggagaattcaaaagcagtcatgagattgatatggtcaggggaatgtgggcacagctgctatgtgctatttctggaaaggagatttaagaggagcaggtgtccatgatgtgttttcccttctccatgaaaaagaggctttgttagaataggatcacaagtagaggtgatgaggaagtgaaatgtagccacctccagatgagtatgtaattcaaagaaaaaataagctttagttattttaagccactcatattttgtggccattagttgctgcaatataatctagcctctcttatctgatacatcatgcaaatttcatcaacctaataaattctttaatctgattcatcaactgtaaattttaaattctatctacagtatatcacatgaagtattttgataatttagttcatttatagattcaataacaattgctaagtatagatattgcataaataggaagaactcatcctcagccatatttgattttcaattttagcgttttaatctatgccattaactttatgagaaaataagtttaatttaaaaagaccttgcagtttaatggggtataatttccacctagtatatgccttaaatttttaaagcaatcttttctttcaaaaatttcctccaaatacctatcggtattcaaccataaaacacactgaatgattaggtattcattatacattttttatttctctatcttatgtattgaaaaattctgtgcctcttcaaaaactgtaaactgtttttaaaaagattgttctgctctttgatgtttattttctggttgtaaagatttggcaatcttacattgcaaaataaattcaaatttgattattcccttaaaagctataaaatttatcttaaccctccagcacattttttaacccctacaaaccattttgcctccctttttaaaaggagtttttcttatacatttaatcccaatctctcttttgagacatgattgttctagaaaaattactgtattccaaacagtcacattttctagctataataaaaagattccctaaagaaatagaaagcactgacatgactttctgacaagaaagataagtacaaagtgttggtcagatttatttcattgtcccagttccttattttgatctccaatatatttttttctttattgtatcatagataggtcagttcttgactcatcatgtagccttcaagaaagagattttccatttctgtgttcaaatccactcaaggtttatttagggcattctcttgtgttgtatttaatcctatctttttttttataataaaagggcttgtgctgaaactgtgctgtgaacagaacataagagaaacatttgacaactatgttctttgggtggtgaacagaaatttggcacttgctatcagcttctatatggagaaaaacatgagctactgcagctgccaacctgcagcaccccctgagtggagctcagggtggagaccaggagtgaggcactctgtgctctggggaaactggaagagcaggtcttcagatggatatttttaggagattttatgagcccacttctttgatcttctcatatctagaaaaacactcaaatccttcaacaatgattgatgtccgtgactagcagtaaccttcacgagcccagcagcaaatattgtatgatgtgtgcatggctgcatgcacctcccccttcacctttgtcacttatatcttgatatttctcctttcctctttggggcgatacttcagagctgtctgaaatactgccatctgggctgtagtttagtgcacagaacaaaagatgtcctggtcatgagtcaatgcagcccaagggtgggctggtaagccctgagggaactccaaaagataccggctcacagctgaggtacatatcaaaggagtgattccagtaagcccagacctttgcatcttcccatagaaactggtttcctgtaaatctttttctgtaaatctggttactggtaaaccttttgttcctactaccttcccttttttgtgaaaactaatattttctgtgccttgccccccctgcctaagtttctcagtgctacctgagatgctctgacttgaacttaagtcctaattttaccccaagtaaaacttaactctcaacttacaggttgtgcttttttttaagtcaacacagtatcacacagcctctaacagacatactttaaggcatcttggaggttctccaaataggagatacagcatgcagtattttctgaaataatttgaccatggtgtcattttattaaaagaataactttcagaatgtcactccctgtatcttatcttacaaaagaaggactagatcgatggtgtggtgtttctaaaagaagacagtacttgtttaccattgaacaagaagaggatctttctcacttgagaaaaacatcctcttttaacagagattgtttttttttaggaatgaagtatgattggacttgacatttgaaggaccggtaagatttatataatattctctatctgaactctaaacattgctcacaagctgtatcattgcagattgctctgaattaaactaattatttcatccattcttatcatacaatgaaaaagaaataccctactttcttcaaaaagtgtttacctgatagagtggtgtttacttgatttcacaaaaaagagttgtttccctaaatctttgtttaaaaacctgccatcacaagagagtctgtcttttcggtgaccaaatgtagttttcgttctgtatgcaaagttggcatctagtattttccttttattattcacatcagataaacaaaaattgcatcagtttataacttctgcctaaaatatctctggcttatggagcaattgagataaatgagttttattctctctcttcccagcctggtgggtggacatttatattgttcttcctttcagatgcagttcattacagagtcacccccaagtcagaacaaaaacaaaaagtttttctgactctttcttttatcctttccttggtttatgttataagccaatgtaataatactgattttaactttgggaattgaaggtgtctgatataaaatatttatttgttctcttttcttgccttgacaaagccaacatttaatggctttctggaaagaaaatgcaatatcaaagcccttgtgcatttcccaaagtcatttttattctggcatttccgggcatttcctagattgcctatagcaatcaaaatgagtttggggggtttttttgtttgtttgtttgttttttgagttctcttttgcagtcataccactttcttctctacctttcctgaagctgagtattttgctttttttttttttttttctcaagccaaagaatatatgcaaaggaatgctacgcttccactggaggaagtctagctcattttagattacatattttgacctcttgccaccaccgactatcccttctgtactttgtttggcattaaaaaaaaaaaaaaaaaagaaaagaggagtt

SEQ ID NO: 53 - DNA, 8719 bp, Artificial
  ss402
agaggatattacaagcctcaatatatatgcccctcatataggagcacccaggtgcctacaacaaatactgacatacgtaaaaggagaaatggatggtgttgtgagacatgtttttataatattttcttagcctctttgctgaaaactccatcttgtccttccttactttttcccgttttccttcttgagaaccagtcacagtaatggtaaatgacttaagcttaagaacaaagacctaaaggcatgagttattcatagggtcagctgaatgaggacataatacattggtctaggcacaccggacctgtgcagattggaatgccatttgcgcaagcatgatatgtcctctaaagaataagagaaagaggaacctcatggccaagtggtttatgagtggtcgttagcagaatatgcattagcaaagagaaccaaggtgcaaacctaggcacacagggttgccacaaataggcatgcctttgtagaagctcagtgaggattctctgaaatgctgtgcatagatagctaactcaaatgctaatgatttttaaatgcctaaagtttagagtaaaagtttaaccatctaccacataagtgacccttaaaaataataaaataacttataaaataataaaaaaaacctatatcctgcacctgcaatccccttttcacttgacataatcctcaagagcacaataaaagaagtgtggtttcttgaggcaaggctcttggtccctgagaccttgagtcccccagttcccacctttacttaaggtaactgtctctgtgtcttgttttatgttaaatttttttccttaagttccacagccccattcttcagccccatcctgatgagctggtctcggcaataaaccattagaggacctattaaaagaggcataaaatatttatatgagaagggatgaagaaaaccaaaaaacaaaggacaagatcatgtttacatatcaatgaaaacaagacaggtcaaataaaaggtgtcctaaggacaaaagtaagagagagtcacaatatcagcctcactgatacccacccagaaacaaggcataagggaaaggggaatagatggcaaggtgaaagccggtgctttaggtgtggcaaattggaacatttcaaaagggaatgccctgaatggaaaaaaaaggaggagaaaacaatccctctcatgttatttgaggaggataaggactggggggggggcaggggctctcaatagtgatcgactgactaacttaaaaacccacaggagccctacccagagcccttgataaatttagaggtagggccataccatgaaaccatgatttttcttattgatttgggggcatctcgctccaacgctttgttatttgcccaaagggttttctccttctcgtgaatagatactagtatctgtggtaaaaggggagggattttcagcaaaaattttagaagaaactaaagtaaatttccaaaatagatgtgccaaaatatgcttcctttttgttccagaggcctacacaaacatgcgtggaagagacctaatggccgaattgggacttggcttacaggtaaccaaaaaaactttacaagtaaaattgaatcttttaaccccaacagtggatggacaaattcaaccacaagtgtgggcatcagaggtaaatcgtgggggacttaaagtgaccctaattaaaatacagttaaggatctatggagaagtagtctggagaaaaaaataccctctctctctacaaggaaggatgggacttaaatcaactatagaaggactacttcaagagggtctcttagaacacttcatgtcttcctataatacgcctacactacctgtgcataaggaggatgggtcctattgcttagtccagggtttgcgggcaattaaccagattgttaagactaaacatccaatggtcccaaatccttatatcctcctgagtaaaattccatttgaccaccaatggttcagtgtaattgacctaaaggatgccttttgggcatgcaccctggactcaaacagtcgggatctatacaccttcgaatgggaggacccagtaactagaaaaggaaaacagtataggtggacagtcttccccaaggggtttaaagactccccacatcttttgaggcaaattttagaacaggtgttggaagattttacaccccctcatggggacatgtctactcaataggtagatgacttgttactctcaaacactgatcaaaagaaacttagagcaactacagtttcccttctcaattttcttggggaacaaggccttagggtctccaagaagaagttatgatttattaggacctctaataagtgggggtaaaagaaaacagcccagaaaaaatagagcagatcataggcctgcctctaccaactaccaaacatgaatttagaaaatttttaggcctgatttgatattgccacctttggatcaattcttatgcatcaaaaactaaaaatctatattctaagcttgtggaggaaggccctgatcctcctatggagccataaggaaatacaacatttcaggggtctgaaggaggtgctgatgggtgcccctgttctggctctaccatcctttgagaaaacttttcatttatttgtaagtgtggacaggggattggctctaggggaccttacataggaacatgggggaagttgccagctagtggcctttctttccaacctcctggacactgtcaccagaggatggcctgagtgcatacagttggtagccaccactgccctcttaactgaagacagcaggaaactcacctttggaggaaggctaaccatgagtaccccacaccatgtacaagacatcctaaaccaaagggtagggagatggctcactgactcccgaattttaaaatatgggcctatattattggaaaggggtgacaatttaaccactgatgaggccttaaactctacttttctcctcactcaaagggagccctcaacttgcatcaaacatcattgtttaaatttaatagactatcagatcaaaactcgacttgatctatgggaaagtcccttctgttcagggagatatttatccattgatggattttcttaggtcatccaaggaaatgacacaatggtcactcagttattgatggagagactcaatcgatagctgagtcaggaagaccctcaaatgcatggtcggctcaaacttgtgaattctttgcccttaaccaatccttaaaatatttaaaaagaaaggaggacacaatctatactgactctaaatatgcctttggagtggtccatacccttagaaaaatttggatggagatgggacttattaacagtaaaggacagggactaatacatgaagaattaattaaacaagtacttaataatctccaactcgcagaagaaatagcagtggtatatgtaccaggccaccagaagggggcctcatttcaagcccaaggaaataccttagcagatgaggaagccaagaggttggcattagaatttgagtttcctatcttccatcttacttcctcccttcccaaaataataatctctccctccttttcaaaaaaagagaaggaacagctacatcagctggggacccaacctgacactcagggaagatggttcctctgggacaggaggaaatgctatccaaaccccttatgagagaaattctgacatacctacaccaagggatactttgggggcctcaggccatgtgtaacacagttttatgggtctgtgggtgtgccagtatttacacaatagccaaacaggtaatagaaggttgcttaacatgcaaaaagaccaatgaaaggactttacaaaaaacaggtaccagaggaaggtctcctggtttaaggccttttcagagtatccaaattgattacaatgaaatgccccaaatagggtgacttaaatacctcttagtcatagcagaccatctaagtcatagtagactatctaactctcatctaaccccattacccagtgccacctccaattatgtgacaaaggccctactagagtaaattattccccaatttgggatggttgaaaacatagatttggataatgcaagtcattttacagctcagataataaagggactctccaaagaattaaatattaaatgggaataccatacccatggcatcctccctcttctgctccaattgagagtatgaaccaaaccctcaaaactcacttaactaaattaatactagaaacccagctaccctggaccaaatatctccctattgctttactcagaattagaactgtttcctgaaaagatgttggtctatctccacaggaaatgttacatggactatcttacctaggtagatcatctgacctgcctacctttgaagccaaagatcaatttttaaggagttatgtatttggtttatcctcttctcttcactttctcagacagaagggattactatcccaggctccactgcttgatttcctgctccattcacatcagcctggagactaagtgctaatcagatcatggaaagaagacaaactccagccaacctggaatggaactttctttgtgttgctgaccaccaaaactgaagtttcaatggctgagcaaggatgaactcacaacacctgggtgaaaaaagtggggccatagcagacaaaaaacaacgggtggcttctccaggaccactgaaactcagctggtcttaaaaagggcttaaaattattcctgatatgggtgactatttgtggatcatttgtatttggtaatcagggtgaatcatgggaccctctaactccaaaatattatcaggtcctgggattatgggcaggttatccacacacattatttattaatttaacccagactcctaacccaatagtcatacaatttgatgcttgccaggtcctagattgtggaactctagaaattcaaagacaactttcatctgtagataaatatctttgtccaaaactcagcccacaaaaactatatagacaagggaaaaaacaggactataaatactataaaatccatgtacaagttggaatgatgtttggtggaccacccaatacaaggggtggacttcccccatgctcataatttatgagcattaaggagcaagattcacatttcaaagggagagcccccaattagttgtacccacttaacacataacccaatcttgttgactatcaacaacccagtcaccttagcccagccaccatcagtggcaactcgtatatacagtttaggagctgatatttctgggtaagacccagtgggatgaatggctcttaggttaatgccttcaacccaaccaaatactctttcttcccaatctccaagatccactcctctccttagaccctcacctcttcccaatccacaccctcaaaataaccctaatatagctaaaatagtcaaaattactagactcaaacaaacaattcaggtagaaacaggatatggggacacaaatgcctgcttgaaattaataaaatatcctctgggcacactacataaaagcaattgttatccctgtgtcacagggagaccagaggcccaagtggttccctttcctctgggatggtcagacccacagagtcctgaatgtatgattgcccttttctaggacaacatggcttggaataatgagtcctgtcagaccttgtcactgctatttcctgaagtcaaaatttccatggatcagcccctgaaaactgtttggctaccaagtaaaaacatcaatttctcctcctgtctagaacaacaggaggcagagacaacctgaccaggtgcagtgaaaaccggtcccacaacaccatccacaataaatcccagttcggagtgccccaggcagatgtctggtggtattgtgggggtgcactaatgggcagtcttccagaaaattggagtggcacctgtgctttggtgcaattggccatcactttcaccctggcatttaggctccaatctcaatctgaaagaaatgagacaccactccagaggggtcctttgacccccaggtttatgttgactcaataggtgttccatggggtgttccaaatgaatttaaggcaagaaatcaaatagctgctgggtttgaatctgctctcttttggtagtcaaccataaacaaaaatggtgattgaataaactacatatattatgatcagcaaacatttgttaattacactagggatgccattaaagaaatagttgaacagctagggccaacaagtcaaatggcatgggaaaatagacttgctttagacatgatgctgacagaaaagggtggagtctgtgtaatgattggtatccaatgctgtactttcattcccaataacaccaccccagatggcaccatcactaaggctctatgtggattaatgaccttagtaaatgagctttctgagatttctggtattaatgaccccttcacagaccttttagaaaattggtttggaaaatgggagagactaatagcttcaatctttacccctcaaattgctgtagttagtgtccttgtcttagttgcatgttgtataattccttgtgccagaggacttacttattcaaagattaatagagactgccctaacaaagcaactgggggaccccctccccaccaagccaatatactcctgatggacacaatagagcatgagaaccaaactatgcccaaagagtttgaagaaaataatatttgatataaaaaaatgaaaggggggaattgtaaaagtaacataatgtcttttctatcaaaggaaatctcatttaatccattttgatccagttttggctgaaacgtctccctgcaacccccttcctctttacctattttctcagcaacaatttgtttcaattggccaactgggaagaatgtgtgccctgatctaaccaatgggaaataagaaataatgcagtgctcatttttaactccataaaagagcaccttgttattcatgtttatcaccatttttcattcaataaatattagttgaaattaataagcagtagcaaaggaaatgactcaaaattatgagtttcccatgaaatcattagtgattttagttataaatgatcataattgaaaaccaaatgagcaacaactaaaaaaacagtgctttagcacatgtttatttccctgaagataatacataaattaggcagaaacatgtaataatgatacatttcacttactgaataaaaagaactgtcccaattataaaaatatgggttaaaaaaactaaaaatataattatttacctagtggaggtaaaaagaccaatatatatgtactattttctttggcttgtgtatgcataaagtaacattaataagatttatatacatacatatatgtttgtgtatatgacaatgaaattaggcaaagtttgaagtggtaatgagctaaatagttcttgaattcctggaagattatgattcaaattatatttattagaatacccataactatgtctgtaaaagaaagtcttgctattccaagatatctcaagtagagatttcctaggagagcctgtatggtaatttcatagacacaaagagtaaaaatagaaatttggaagtaaacaatgatgaattaatattgagttatataaaaagaatgaggtcatctctgtaaagattatcactaaaataaaggacataaaaatggagacatatcaaacgtaggaaagaaatttaacaaatccataattaacagaatttcaaaatataatagattgacactagcaatgaacaataagaaaataaaattaagtagtccatttgtaatatcatcaacaataataagatatattacatgctatatataatatatgttatatataataaatttaacaaaatacataagatttttatacttggaaactacaaaattttaaacattaatagaaattcaaagatattctgtcaattaattggaggatttattatcatgaggctgaaaatatcacccaaattaatttatagacctgacaccatttctatactcttttttacatattgtcaaaatgatcctgaaatttaatggaaattcaagatacctggaagagcataagcaatttttactaagaagaacaaagaaaactcacactttgattttcacttacagggagtctataatcaaggcagtgcaacaataacataagaatagatatacagatgcatgaaaaagaagtgttgagtaattgtatccacctgtgatcaacttatgtttaacaaaagtatgaaaaataatttcacatagacattatagtctctttgacaaatagtgctatgacaattggatatgttcaagcaaaagaataaagtttgacccctattgtcaggagacatgtttctacaacatctattagcctctctggttctattttctatgataaaatctccatcatttcctgctttacctttaccctatattcctgcttgaaaaacagttgcagtgctggtaaaaaaaaaaacaaaaaaaaacaaaaaaaaaaaaccttaagcttaagaacaaagacctaaaggcataagttattcatgtggtcagctgaatgaggacataatgtgttggtctagcatgcagtttgcacagcatgatatgtcctgttaaaataagataaagaggagcctcctagccctagggggtttatgaggtaaaattttgaagccatcatggaaaacagtttgggatttatgca

SEQ ID NO: 54 - DNA, 11034 bp, Artificial
  ss405 sequence
tgccatacttcaaatgccttagatacaatttgagtctgaggtacaacatctctaattccctgaattatgagatttctcaagtccatcatatgcctccagtggagagcattgttattgtccaacctgggtcctaggtttccaccctaacttccctgagctggagagggtgggttcactcccaggaggccatggctgccttttgaatcatccccctttctttcttggaaaatagaatgctcaaaatagacattaattctgaccatgtatagacttgtgttccaaggaactgatccacttgatctgctaccccatatgggtcctccagcaatggcctcaattccctcttaaaaattcagacctcaggactggttaaaggggcatttacatatcctattcttccccctcctaagggaatttcccatagtgggaataatgtttgtggcatttcttgtcagtccccaggggtagcgatgggaaatggaacattttgaataccctcctgacattgttttaactctcgcctaagtctggatcaaggccctataatatcctttgattttattgagatggtggtctttgaccctgcaggctgcttggcagtgtgtttgtacctgtgcagtggaccctgcatcactcccctcatgagcggactccatgagcaggaccagtgtgctcatgcctgtgcaatggccttgccaccctcaccctcccatgctcccctagtggcgacagtggtggtggctgtagtaggaggggggtagtgccaatttggtgattgcaaggtgaatgttctcgggtttcctcttcatttcccttctgttcccatgctgaggggaaataagaccaccggtccctgccaccaacagaaagcataatcagtttcctcctgggaccctggtgtcttgtcctggacaaactgaatgatcagctgacagacccaatccttgtccaatctgaactttggccagaagatggatggggtaagaataaatgtctgtgtccagataaagcaacaatattcaatcattcttcccttctttttgtccttcatccatggatttttgccccaatactataacattaatcccagaggactgtctggaggaatttggtttccccatccatgcagagatcctctgagtggaggcacgagtcaggaagacttacttcccatttccccaggatggtgccctgatcttctgatttcaccccaaatcatctatatcactcaagactgctggtctcacccaagaccttttgaggatcatgctctgatttttctgatttcagctgaaattgccaatctcatgtgagactttttaggtcaccaaaccctttccctgaccaccaaggagatactcaatcactcccaccttctttcctatcttggtccatgcacagagtcacctggtcaccctgatcacagtttttctcagactgtcctcctgtgttgttgagaatccccccatgggtttgaagttcacaggctcagacctctcaattcaggaccaccacagtggggccgagggataggtatctcctccttaagaattcatgctccggtggaccctaaatcctggaaaagcccccaaattgttgtggaaaagtgaccctggctcagaacatcattatcagaaagtaagacacatgaacacagggacatctcaataaggctctttatttctgcaaaagggcacaagtgctccctgtcaatgatgagcaaacaagtgagcaagtacatgtgaagaaggaagaacccactatttatccctaatgcaggtggtatatctgtctccttccaattggttaggtcaaggagaacattcttctcagctaatttgaaacaaactgttactgggaggagaggggaaaaggaggggtgcaggagggtgtcagatgaagcaggagcaaagtggagtaaccaagacttcctttgatagaaaagacacatgttaatcctcacatcatgaaggttactgctagtcatacgaaagatgtcaccatgaagtattttagtgcttttctagatttgaaaagatgtaagaattgggctcataaaatccactcctgaaaatatctatatgaagactttttctgcctgttttctcagtgcccagagtgcctcaatcctaatctccaatctgagttatctcctgcctcaccctgccagctgaagtgtttcatgattcagtttgagtagaggaagatggaaagtgccaaccttcagctcacaaacctaattaacactaattattctactgtttttattagcatttttaatatccatggaggggaaacagacaccacacacacaaacacacacacacacgcacactcaccttttaactcatttttcccttaagtaatgataaaacaactgtttataatgatagctctctgaaaatataccagtttagaagtttctctaatttgaaagataaaatatctagccattaatcagatatattttgataatgactcaaacaagtaagacaaaaatatttccccacaagagattgtgcaggatactgcctaaaccagatccagaaaatttactaccaaaaataatttaaggggtttcccatggtggcacagccgaaaggaatccaattaataaccatgaggttgcaggtttgatccctggcctctctcagtgggttaaggatatagcgttgctatgatctgtggtgtatgtcacagatgtggcttggttactgccacatgcaggcacaaacatgctgctgccccccaaggggtcagattccatggcctcaacaaaatcaaggaatatgacagggccttattccagacttaggtgagagttaaagaaatgtcaggaggatacacacaattttttgcttccctctgctgcccctggggactgacaagaagagacttaactgcaattcccactatgggagtttcacttgggtgggaacaaaataggataggtaaatgcccctttaatcagcactgaagtctgaaattttaagagggaatggcagacattgcaggaggacccgtatggggtagcagatcaagaagctcagttccttggaccacaagtttatacatggcccaaattagtgtctattttgagtattctattctccagggaagaaagagggatgcttcaatgggcagccatggcctcgagggaatgaaccctgcctccccagcccaggaagttttggaggaaactaaatttcccaatgagggcccagggtgggacaataataatgctccacaccaggggcacatgatagacttgagatatctcataattcaggggactagagatgctgtacctcagactcgaattgtagctaaggcatttgaagtacagcaaggtaaagaggaagggctaactaaatttttggaaggactcagagctcaaataagaagatacaatggaatagattccatcaaccctgtaggacagtgcatgttcaaacttcattttgtaactaatagttggccacatatttccaaaaagttaaaaaaatagaggattggaaagataaatcattagaggacttactaaaagaggcagaaaatgtttatgtgaaaagggatgatgagaagcaaaaacaaaagaccaagatcatgtttgcatatcaacataaacaaaacaggttgaatcaaaggggtcctaaggcaaaataagagacggtcacaatatcagcctcactgctacctaaaaatgaagcatggtgaaaaagggaatagatggcagggtgaaaacaagtgcttttagtgtggcaaattgggacatttcaaaaatgccctgaatgggaaaaagagaaaaaaatcctctcatgttctttgaagaagatgagcactaggggcttcatgagctctcattagttatttatgaacttaaaaattcacaggtgccctaccaagagcccttgataaatttaaaggtaggtccacaccatgaaactatgatctttgttattgatttgggggcatcttgctccttgccttgttatgtgcccaaaggactttctccttgtgaagaaatgttagtatctagggtaaaaggagagggattttcaagcaagaatcttagaagaaaccaaagtaaatttcctaagcagatgtgcaaaatatgcttgctttttgttccagaggcaggagcaaacctgtgtggaagagacctaatggccaaattgggattgagtttataggttaccaaaaaaaactagacaagcaaaactgtatattctaaccccagcagtggaagaacaaatttaaccacaggtgtgggcatcagaggtaaatcgtaggggatgtaaagtggcccccaattaaaatatagttaaagaccctgggaaaagtaatctagaggaaacaataccttatccttctactgggaaggatgggacttaaaacaattatatagggactattttaagagggtctcttagaaccttgcttgtcttcctacaatacccctattctccctgtgcttaagatggttgggtcctatcatttagtccaggacttttgggcagtcaatccaattgttaagactaggcacctagtaatgccaaacccttataccctcctgagtaaaattccatttgaccaccactggttcaatataactgacttaaaagatgccttttggtcatgccccttggactcagattgttaggacatattctgcttcaaatgggaggacccagtaactggaagaagacaacaatgtagatggacagtaccccctcaggggcttacagactccccacatctttttggacaaattttagaacaggtgttgggagaacttacctccccccctccatgggacctgtcaactccaatatgtagatgacttactactctcaaaccctgatcaaaaaaaaacttatggcagctacagtttccctcttcagatttcttggggaacaaggccttagggtctccaagaagaagtacaatttgttgaaaaagaggtaaaatattgggacatataataactgggggtaaaaaagaactcatccagaaaggatagaggggatcatagacctacctctgccagctaccaaacataaacttagaaagttcctgggcctgattggatattgtcacctttggattgattcttatgcattaaaaactaaaaatttatactccaaacttgtagaggaagcccctgatcccctactctggagtcaggaggaggtaaaacaatttaggattctaagagaggccctgatgggtgcccctgttctggctctaccatcctttgaagggcctattcctttatttgtaagcatggacagggggatggctctaggtgtcctcacacaggaatatgggggaagttgccagctggtggcctgcttttcctcctcccagaccctgtctcaagaggatggtctaagtgcatacagacagtagctgccactgccctattaactgaagaaacagaaagctcacctttggaggaagctgacatgaatactccacaccaggtatgagccatcctaaaccaagggtagggagaggactcactgactcctgaatcttaaagtatgagacatcttattggaaaaggatgactaactttaaccactgatgaggccataaaccctgcttcttttctcacccaaaaggagccctcaactccaattgaatgtcattgtttaaatttaatagactatcagaccaaaacttgacctgatctatggaaaactcccttccattcagggagacatttcttcttaatggatcttctcaggtcattcagggaaaacaacactgagcagttgataggctcagtcaataattgagtcaggaggacccccaaatacatggtcagctcaaattacgaactctatgtccttaaccagaccttaaaatgcttaaaaggaaaatatggaacaatctatactgactctaaatatgcctttgggggtggcccatacctttggaaaaatttggatggaaagaggacttattaacaataaaggacaaggattaatatgtggagaactaatcaaataggtacctgacaacctccaactcccagaagaaacagtggtagtatatctgccaggccaccaaaaggggatctcattttaagcccaaggaaactccatagcagataaggaaaccaagagagtagcattaggatcagaggtccccatcttccatcttactccctcccatacccaaataatgatctctctttccttttcagaaaaatagatggaacagctacatcagctgggggctcagcctgatgctcatggaaggtggttcctcccagaccaggaaggaaatgctatccaaaccccttatgagagaaattctgatatacctataccaaaggagccattggggacctcaagccatgtgtgacacagtcttaaaggcctataagtgtgccagtatttacacagtagccaaacaagtaatagaacattacttaacatgcaaaaagaccaataaaaagactttaaggaaaacagctactggaggaaggtctcccagtttaaggcctttccagagcatccatattgactatactgaaatgcccaaaatagggcaattcaaacatctcttagttgtagtagaccatctaactcattggatggaagcgtcccattacccagtgccacagctaattatgtgacaaaggccttattggatcaaattattccttatttgggctggttgaaaacacagattcagataatggaggtcattttatggctcaaataataaagggactcttcaatggattagatattaaatgggactatcatactgcatggaacccccccacacttcttgtcaaattgaaagaatgaaccaaactctcaaaactcacctaagctaatactagaaacccagctaccctggactttactcagaattggaacttctcccagaaaagatgttggtctatatccatgtgaaatattatatggacttccttatctgggtagatcatctgacctgcctacatctgaaaccaaagatcaatttttaaagaattatgtgtttggtctatcttccactcttcattttctcagacatgagagattactagcccagactccactgcttgttttcctggtccatccacatcagcctgttaatcaaatcatggaaagaagacaaactccaaccaagctgggtgggacctttcctcatgttgctgaccattgaaacttgcagtttgaatggcctagagaagatggaagaaccacaccttggtgaaaaaaagggggctataacagaaaaaaaaaaaaatgggtgactttcccaggaaccaccaaaacacagttggtcgtaaaaagtgtttaaacattcttaatatgatgactctttggggatcattaacgtcgggtagttggggtagatcatgggatcctctaatctcaagattttattggggcctgggattatggacagattatctacccaaattaattattaacttaactgagactcctaacccagtagtcaaaaaatttgatgcttgtcaggtcctagattgtggaactctagaaaatcaaatacaattctcatctgtggataaatatctttgtccaggacttagcccacaagaactgtatagataagggggaagatgggaatataagtagccatgtataagtatccatgcataagttggaatgatgtttggtgggctacccgatagcaaggggtgggcctccccccatactcaaaacttacaagcattaaaggacaagattcacctctcaaagggagagcctccaattagttgtacccactgaacatgtaatccaatcttattgacaatccagccacactagcccagtagccagaaatggcaacttgaatatatggtttaggagctgacatttctggaatagactcagtggtaagaatggttcttagattggtaccttcaacccaaccaaatactcttccttcccaacctccaagctctactcctccaagtccaatgccttgttggaatggataaaatattttgtgggcccactacacaaaagcaagagttaatgcttgtgccacagggagaccagaggcccaagtggttccctttcctctgggatggtcatcagacccatggggtcttgaatgtatgatggccctcttccaggacaaaacagcatgagtcctgtcagactttgtcactgatactccctgaggtcaaaatttctgtaggtcagccccttgttggggaaaagtgacccctgcttggatcatcagtgttggaaagtaagacagatgaacacggggacatttcaacaaggctctttacttatgcaaaagggtggaagtgctccttgtcagtgacaagcagccaagtgagcaagtgtgcacaaagaatgaagaacccattatttatccctaatgcaggcagtatatctgtctccttcccattggtcacgtcagggcacacatttttctcagttggctaatttgaaacaaactgttactgggaggagagagaaaaggggagggctggaggaggctgtctcagacaatgcaggaacaaaatggagtaaccaaggcttcctttaatagaaaagtcatatgttaattctcacaccttgaaaactgttcagccatcaaatgaaaatgttaacttctccttgtgtttagaatgacaagaggcaatggcaactttcttaggcaactgtatcaggtacagtgaaatctgatcctacaacatcctgtacaataaattccagttctgactgccctgtgcatatgtctggtggtattttgggggtccactaatggacactcttctgaaaattgcagtagaacctgtactttggagcaattggctatgccttttgccctggcatttaggttccaatcccaaactcagccaatccagagggaataagacatcaccccagggaggggaggtctttgactcccaggtctatattgactcaataggtattccatggggtgtttgaaaaaaaattaaggcaagaatcaaatagcttctgggtttgaatctgttttcttttggtggtcaatcataaacaaaaatgttgattggataaactacatccattcctatcaacaaagatttgttaattacactagagatgccaattaaaggaatagccagacagctggggccaactgtttaaatggcatgggaaaatagatttgctttagacatgatgctggcagaaaggagtggggcctgtgtaatgattggcatccggtgctgcaacttcattcccaataaccctgccccagatggctccataaccaaggccctacccgggctaataaccttagcagatgaactttcagaaaattctggtagtaatgaccccttcacagacattttagaaaattggcttggaagatggaagggactaatagcttcaatccttacacctctaattattgtaattagtgtccctgtcttagttgattgttgtataattccttgtgccagggggcttattcaaagattaatagaaaccaccctgacaaaacaattgggaccccctccccagcaaatcaatatgcctttaatgagcacaatagaacatgaaagtcaaactatgctcaaaatgtttaaagaaaagaatatctgatgaagaaatgaaagggggaaattgtgagaattagcatatgtctttcctatcaaatgaagcctgggttaccccatttttgttcctgctttgtctgaggcaccctcttccacacctctttttcccaggaacaatttgtttctaattagccaacccagaagaatgtgcaccctgacctgaccaatgggaaggggagagatgtaccacctgtgttagggatgaatatgggagtcttccttctttgcacatgtttttgagcacttgcacccttctgcagaaggagccttgtcacgatctccctgtgtttgtgtgtcttactttctgacactgatgctctgagccagagtcacctttccccaacacaattgaggagacaggtatagggtcaaatcccaggacagaaggtagttaatgtttgtaggtggttaatatatggaggtcattattttcaacaggccattgtttctcactgcccaacttgaacatccatgttccaggagggggtcaaatcttgccctggggagggtggaggtcctaacaccattccccaaggaaactatcagttacaacaaaaaaatatgcctcatcggagtaagaattattttaaactggatggttttttttttttgtcttttgttgtgtgttgttgttgttgttgttgctatttcttgggccgctcccgcggcatatggaggttcccaggctaggggttgaatcagagctgtagccaccggcctacgccagagccacagcaacgcgggatccgagctgcgtctgcaacctacaccacagctcacggcaacgccggatcgttaacccactgagcatagggcagggatcgaacccgcaacctcatggttcctagtcggattcgttaaccactgtgccacgacgggaactccttaaactggatgtttttaagaaacagaaaatatcagaaatgctctgaaaactggagcagaagttatccttttataaaatacatttacatttgtaagggtcatctgctttggcaaagatctttcctctgtgccaggatgactatatctttagagactcttacagataacagtaacttaaacctgcatagcaagtgtatccccatttactgtgcctttcctggtaatctcccataagtggccatctgattttcccaatatttaattttttttaaaatttttatttttattttgctttttaaggccacacccagggcatatggaaatttccagcctagggatcaaatcagaactgcagctttggcttacaccacagccacagccatctggaatctgagccacacctgtgacctacaccaaagctcacaggaacaactggatccttaacccactgagccatatcattgatggaacctgcatctgcatggatactagttaggttcataatctgctgagccacagtgggaactctgaca

SEQ ID NO: 55 - DNA, 11559 bp, Artificial
  ss409 sequence
gcaagcccaccttcctcctctggtaagggaaaaaaattacagaaatagtcagatgaatctttactaagattccactgtcaggaaaatctcagggctcctttgctcagattagacaagggcctaatcaaccttacatggaattggttaatcaactccaagaggcagtataaagacaaattgataatctcaaagctgctgaagccttactaatgtctctaacagtggaaaatgctaatgaggactatagaaaaattataaaatccctaaaactgatcccccaatatccaacagcgaccattgctcaatatattaaagcttgtcagaatgtgggctcagaatcttataaagctaagcttttagcagtagcccttaaacaaggaccaaatctggccatctgtttaaatgtggaaaaaggggacatttttaaaaagaatgtagaatagaaaatagtagaggcccccctaataatttgagagaacctggtatatgcccaaaatgtaaaaaaaggaaaacatttggctaatttgtgtaagtccaaatttgacaaagagggcaattctatctcttagtcctggcagggaaactggaagatgggcaacccttccctagcccaagaacaaagaaggaggtctttttcccagagatgagagacctggactgcccagctctaggaacctcagtggccaccttatggtctgccacaagaggaagcacaggattggatctcccattaagtaatgatgtcatttgtgatgaactgggaaaggtttgtcttctctccaccagagtttatggacccttacctaaaggaatggtgggattaataattgccaggtctagttctactttaaaagggatacaaattctcccgggagttattgatttggattatttaggtgaaataaaaataattgtgcaagtccaccaacttactgccttacaaaagggccaaaaattgtttaattattgcttccgcctttctggactcctcactcaggcattcaagaaaaaggaaaagctaattttggaagctcttctcataaaagagagcaatactggcttgctgaaataggagaacataaacctcttttccaactactcctagaaaatcaattctttgaagggttaatagacactggagccgatgggacagttatttcttgtcaagactggcctccagaatggaaaacagagcctgctcctgatggggagttgggggacaactgagagatcgaaaaagtaaaaaggaattacaatgcaaaggaccagatgagaggactgctgttatttagccttatgttttgcctattgcaataaatccgtggggccgagattcactctaacaatggaagataaaaattcaaacttttatttctgactgccactgctcaggcgctactataccccctaaactggaaaactaataaacctgtgtgggttgagcagtggccattaaaagggggcagattagaacatcttaaatggcttgtaaaagaacagttagaggcaggacacatagagcctagtgttagtccctggaattctcctgttttttttttttttgttttttttttttcatacattaaaaaatctggaaaatggagaatattacatgatctcagatctattaattcagtgattcaacctatgggccatccagccatccaggggtcccctccccaactatgggcattaggcattgatcattagccatttaaaaggatccttttttaaaatacccttagcagaacaagataaagaaaagtttgccttaatcatcccttatgttaattgtgcccctccagaaagttatcaatagcgagttctccctcagggaatgattaagatcccaaccatttgtcagcttgtagtggaacatgccttaaagcccatttatgaacagtctcctcaaataatgatttatcattatatggattatattttatttgcccatccagaatcatctgtccttttaaagttattagaaaaattgccacaacactttccaaaatatagcctacagatagcccctgaaaaagtacagcgacaactgacctgaaactatttaggacaacatgtgtttgctcaatgtactaaacctcaaaagttgactttacagagtaatgtaaaaactcttaatgatgtacaacaattgatggaaacaattaattgagtatgacctatgttaggaattaaaaatgaagaaattaaaaatctctcagtgttgttaaaagaagaggacttaaattccccttgagagttaacatctttagcaaaaaaagagttaaatttaatttaacaaaaaattaactcatacttatcatagatgtgacccttatttgcctcttgtcttatttatcctgcatatggaagtattttcagcagcattaattggataaaatatcaatcctaataaatgtgttgaatgggtatttctttcattaacacctaaacatactttgactcccataattgtaaatattgtaaacctttttttaaaagccagacagaaatctatacaaatattaggacaggatatacaacaaatcatttttcctctttaaagagcatgtttcaaaattgctattgccacttctatagatctacaataggcattagctgattttacaggaaagataattatcatcttcccaaacatccattatttaaactttgtgaagaacaatttttggtgcctgaagggattattaaaaccttccccacttcagatgctaaatatttgtttacagatgcatctggaaaaactcatcactatggaattacctggtttgaaaaagattggaagtcagtcaaaggaacttctacggatccactcaatatttggaattgttagcaatatttaaagctttacaaatgttttccgatccatgaaacattattagtggttctcaatatgcagtaaaattaattcttcaatttccaatgactgagtgaaaaatcccattggataagcagtttgctttattgttaactttaaaaaacctactcactcagagacatgctcttttgtatactggacatgtctggtctcacacagacttgcccagttggttacaagtagggaatcataaggcagataaattagtaagtttctgttcttttgaagaagctaaacactctcctaatctttctcatgaaaattggaaatctcttagaaagagatttgatcttgtagttctagaggcaaaacaaattgtaagaacttgccctgattgtcaattgtttcaacctataggttttcctggaggaacaaaccccagagtcttacagtctaattagatatggcaaacatgttactcattatcctaaatttggaaaggctaagtttatccatgtctcaatcaatacttagagtggtacctcccatagtaaagaaaatgtcaaagcagcgtttcagcatttagtttcagcttttgcacagtggggaaaacctaaagaaattaaaacagatgatggacctgcttctattaataaaacatttaaagaattctgtcagcttggggaataactcataaaacaggaatcccttacaatccacaagttcaagcaattgttgatcaggtacatctcacasstgctctctgtccaagccagcagccctgctaattaggtacccagcattgcttatcagttctgcttctgtaaccttgcttgctcagtctcttagggaggaacactgtctgcttggggttgggggaggtccgggatgcttacatgggaaaatcaagaccttgtagtgtataaaagttactgaggacaaagacctggtgctcagactctggaggtgactcctctgagcccgcaccggtgctgaataaaccttgcttttccatatctctgagtgctgtttgtctccttccattgccacagtgtttgcggtttccgcaacattttgctgcattggccgggaagccgacaaccgagctggcttcttgtgccaccgttgtgggggaactgggggaggccacggtcaccggcccggtgacaggtggatagcgcacaccggccattttgccggatccagaccctcactcaggccgtgctggccttggcccacaccgcttcccgaacggactcagaaagagagtggaaacaggttcctggacaggacatcggactggtgagtgcccctgtgacatctgcctgagtcaggacccaccatacggcggaaggagaaactgatcacctctcagtgaccaaagggtcactcagtcagggtttgctcccttgggattgggaggctgtcaattctggtgtgtgtgtgtgtgtgtgtgtgtgtgtgtgtgtgtgtgtgagtgactggagagaacgagagcccatgctccaccgtctttggactatggagccagagtgagtcctaacctgcagttccgcggcgacctcatacggcttatggtggccctcttcggggggatcctacgttggggtttatacagtcccacctatgctaagaggcgcctgaaatatctcctccgggggagtggtcaggcgggcgaagcgattgttacctgaggccttgtcctcaatgtttgtcttgcgtcacaggcacagggtgggacttcacacaatgggtaaattggcttccaagcccactgtcttagagtatatggttaagaattttaagaaaggattttctagagattatggtgttaagctgagtcctggaaaactgtgtaccctctgtaccccagagtggccctcctttggtgttggctggcctccggaagggaccttagatgtgttcacagttacagcagtatataaggttataacaggagaccctggacactcagaccaatttccgtatattgatcaatggttggaaattgcctatttgaggcccccatgggtttggttctgcaccacagaccagtgtagggtgctagtagcccagtccaagaagaaaaccttgtctcaaaagagggtgccacctatttatcaaggggaacctgaggactcaccccctatgccaccaccttatgtgctgctggccccagctccaggagccgaaggtccccagatgccagacagcccaccgccttctgtttctcctcctccttctgcttctgaagttccggaggcgatatcacccccgcagcaagattctccagaacatatgagcaggcatctccgttcagctcagggagcagccactccagcattacaaatgcccttacgggagacacaggaaccacagcaagacgcccccgatgggaccatacaagaggggggacgtttttattatttccagcccttttccactgccaatctcttcaactggaaacaccatactccctcatattctgaaaagcctcaggtgctgattgatctcttagaattcgttttccagacacactgtcccacctggatagactgccagcaactcctttttactctatttgacactgaagagcactggtgaattgtaacagaagcccaaaaatggcttcaggccaatgcggggggtcgagcagacttggcaaactgggtgagggaagccttcccagaagaaaacccccactgggactatgacactgaagaagggaaatgtaacctagagaggtaccagcaggccttcctacagggggcgaaagctggggctaaaaagcccactaatatagctaaatcagtgagatactacaagagccgaatgaaagcccagccaaattctatgagagactatgtgaggctttccgaacctacaccccttttgatcccgaggcccctgagaaccaacggatgataaatgctgcctttgtgggacaagcccaatcagatatccataaaaagctatagcaattagaaggatttgcaggagagaatgccactaaactgttggaaatagccaacaaggtttttattaaccgagaccaggtggcccgccgtgatgcagaaaagagaatgaaacaaaaagtgactcttctggcagccaccctgtcaaaaccggtgcccccagtgggaccaccccataggggacgaggcataaggccagggaaaaggagtcccctggaacatgaccaatgcgcttactgcaaagaaaagggacattggaaaaatgaatgccccaaccgtcctgagaaaaagaccaaggccccacctagccagtactgatctgagccattcagcaccaacctgatcggcctagctgagtctgatcaggggggaccaggctctctccaactgggcccctgagaggctatggtcagaattcaagtagggggccaccccatagactttatggttgacacaggtgccgaactttctgtggttacacaacctgtggctcctctctcagggaaagaaaccaccattgttggggccacaggtaaccaaacccacaggcccttctgtggtccttgacgatgtcggttaggaggccatgaagtaatacatgaatttctttacctgcctgacttcccagtccccctgatgggaagagacctgctggctaaaatggggaccattccccagaactagagactaaatacccattggtttgggctgaaggaaacccaccaggactggcaaaatgccacgctcctgtcttaattgatctaaaacccggagctcaactggtaaagctacggcaatactcaattcccagagaagctcgactgggaatccaggttcacctgaataggctgcttcagcatggactgttaataaaatgtcagtccccttggaacacccctttactgcccatgaaaaaaccaggaacacaggactaccacccagtacaggacttgagagccataaataaagtaacagtcacattacacccgtctgtccctaacccatataccctgctagggctgatcccctccactgctgagtggtttacttgcctggacttaaaagacgcctttttctgcctccaggtggcacctgccagtcagcccttgtttgtttttgaatgggaaaatccacatacagggacaaaggaacagatcacctggactagactcccacaagggttcaaaaactctcccactctttttagcggcgccttagctgctgacctggctgaatttcctggacaaaaactgggctgtgttttgctacagtatgttgacgacctcctactagctggcaccacggaggctcagtgcctagagggaacaagagctctcctttccctactgatggaggcagggtatcgggtatcaaagaaaaaggcacaaatctgcaaaaaacaagtcaagtatctgggcttcaacatcatgcagggccaacaaatgctggggactgaaagaaagcaggcagtttgtgccattcctgtccctaccacccacctgaaggttcgtgagttcctaggggcagcaggattctgccggatatggatccctgggttttcagacctggccaggcctctgtatgaggctctaaaagggcaagaaaaggctccccttaaatggggaccaagtcaggagacagcgtttcagacaattaaaaccaaactcactgaggctccagccttgggacttcctgatgtaactagagaatttaaccttttgtttcatgagaaaaatgggatggctttgggagtcttaactcaagaatttgggccttggcagaagccagtggcatatctgtctaaacaaattgactcagttgctgccggatgtcctccctgcctccgagtgctggcagctatcaccttgttggtaagcgaggctgacaagttgaccctgggacaaaacctcaatgttaaagtcccacactcagttgtaaccctaatggataccaggggccaccattggctcacacatgcacgaatgactcaatatcaagggttactatgtgagaatccatgggtaaaactggaggttgtacgaattctgaacccagccacttttctgccagatgaggcggggacccaagaccataactgcctggaggtactagatgaggtgttttccagcaggcctgacttgactgataaaccactccaaaatcctgacctggttttatatactgatggcagcagctttatggaggatggaaaaaggatggcaggatacgctgtggtatctgacttaaaagtgatagaagcagaggtgcttcctcaaggctggtcagcatggagagcagaattatgggccttaatcagagcactggaacttagccaagaccagctagttaatatctataccgactcacgatatgcctttgcaactttacatgtccatggagccttatataaagaaagagggctcctcactgctgaaggaaaaggaattaaaaaccaggctgaaatcttaaagctcctagaggcagtatgggaacctaaagcagctgcagttatccactgtaaaggccaccaaaagggggatgacccagtgacaaaaggaaaccgtagtgctgatgcagctgccagacaggcagctccgggacaacagccaaaccaacctaaggtcttgctggccccagaagtgccagctgtccccaaatattctccagaggaagaaaaatggataagggaggaaggaggaactaaaactaaaatgggatggtgggtcacacgggaccaccgagtttacgttccagaacagctggcctacaaactagtccgccaagaacatgagctaacccacatgggaaaaactgccttagagaccctactgggctggtactatctcattgcttgtcttcctgcactctgctcctctgtctcccaaagatacataacctgtttacagaataatgcccgccaggggccccaaagaccagctggggcacagcactgtggactgtccccatttgaggatatggaagtggactttactgaggtcacccctagtaaggggtacaaatatttactagtttttaatctgtactttttcaggatgggtagaggccttccctacccgaactgaaaaggcaagggaagtaaccaaggcactcctgagagacattattcccagatacggaatgcctctgaccatcgggtcagaaaatagaccggcatttgtggccaaaacagtacaacaggtggcaaaagctttacagatccgatggaaactacactctgcttattgccctcaaagttcagggaaagtagaacgcatgagctgaacccttaaacagaccctggcaaagttatgtcaggaaactggcttgccctggatagacatgttgccggtggccctcctaaaagtgagatgctcaccccgagagggaataggattcttgccatttgaaatcttatatgaaaggccacctccactaatcagtttaaaaggaaacaccagggagttgggagacttggaattacataaacaattacaaggactggggctcactatttctcagatacataaatgggtcacagacaaaatatctgtgtccttaggtataacagaataatgcccgtacacccccacaagccgggggaccaggtgtggataaaggactggaaaaaggagtctttgaagccggtatggaagggcccctatactgtaattctaaccacccccactgctcttaaagtaacaggaatagatgcttggatccatcattctagagtaaaaccggctggcacagctgacaaccgtggagagtgggagactgccctcccatctggagagacctcttcgcctgacgatacagaggaggagacgacgatctcaaagccctgctctgaccacaccagaagctggtcagtcaacgcatggctgaagcttgaggaatcagctgcctgtgagcccaaatggaaggagggtttcaaaataagcatttgcattgatggaagaggccttgaccctggaactgtgctgcatttccagagaatcacgtttgtgctccaagctgcctctcacagggtctttcattccttttatgaagagataaaaaacaccccacctcccattccggccacaactaagaacttgttcttagccctggcagaaactattgcacaaactctcaaggtctcctcttgttatgtatgcgggggaacgaacacaggagaccactggccttggcaagccagaaaactggacccattagagcctcataatgagactgcatacccccaactcaccaatggggtatggctcctcagaactgctattattgggagaaattgtcttgcgaggcggggaggacagtttaatgttgcagttaaaagcctaacatgtttaggcctaaggtattataatctgactgcccaagagactcaatggtggtcatcttccaatcactcagagcccaagcctaatcccttgtctaacttttccctccttcgacaagcatgggaagatatcagtactaatatccagtggtgggcaccaaagggattatattggatttgtgggaaaaatggcctattccatactcccccccaaattgggctggggcatgtgtactgggaacaatcagaccttccttcttcctgctcccgctgtcactaggggagcaactgggagttcctatatacagggcacagggtgcccagagagaccggagggctctccaaattggagactggaaagatgatgaatggcccccagaacggataattcaatattatggacctgccacctgggcagaggatggctcttggggatatcgcacccctatctctatgctgaaccgcatcatcagactacaggcggttttggaacttataacaaataacactgcaagggcgttgactatactggcccaacaaaaaactaaaatgcgcagtgcaatctaccaaaatcgcttggccttggattatttacttgcttctgaaggaggggtttgtagaaaatttaacttaagtaattgctgtctacaaatagatgacaccggaaaggtggtagaagaaattgctgacctcatgactaaactagcccatgtacctgtacaaacttggaaaggatggaatacagacagtctctttggtaaatggttctcttgattgggaggaattaagacaatggtcggaatagtcatggttacactcgcagggtgcctacttgttccctgccttgtacctctcctgataaatattatagaaggttttataaaaaccatggttgaaagaaaaacagcctcccacctgctacttattagaggctaccaaagggttatgactgatgatgatctgtaaagggtgcagatgcaccctgaacatcaagaggggagaatgaaatggagttttaactaaagaacctccccttggctaagaaggcagctgcaagcctttccagctgtgctcatcactatgccacccttcttgtaataatgtaacaactgtgtgctctctgtccaagccagcagccctgctaattaggtacccagcattgcttatcagttctgcttctgtaaccttgcttgctcagtctcttagggaggaacactgtctgcttggagatgggggaggtccgggatgcttacatgggaaaatcaagaccttgtagtgtataaaagttactgaggacaaagacctggtgctcagactctggaggtgactcctctgagcccgcaccggtgctgaataaaccttgcttttccatatctccgagtgctgtttgtctccttccattgcca

SEQ ID NO: 56 - DNA, 4291 bp, Artificial
  ss439 sequence
ctacctgctccttacaagagaggggatgccctcacataactgagaaaggacaataggcgctggacactggtcttttctctttttcaaatgggagccacatcctcgagcctgacttaaggctcaacagcaactcctctgacatgtgccttgaaaaatgggaaaatttgaccctcaggctccaagaaagaaatgtttaattttcttatgcatgaaagcctggcctccatataacctgtcagatggagagcgatggccatctgagggctttctggcttataaaactattctccaattagacctattttgtagatgagaagaggtgctttatattcagatcgtctttacaatgagggaagcactaagctgaggaaggcttgtggatttccccagtgcattataccaaatccctcagggccaaggtgcccaccgagtcctggctaaattgggtcagaccctcccaaagttaatcggccttctacaatactactcaaggctcctcttctccccttccagtgccaaagttatatacctctttactccctttgcaagaggtagcaaatggacagtggggaccaatgcaggtccgtgtgcctttttctcttcaggatttaaggcagataaaaacagatgtgggaacatttcctgatgatccagatagatacatcgaggtctttcggggtctcacgcagtcctttgagttagcctggaaggacatcatgttactactaaaccagacattgactctaagtaaaaaaataaataaataaggtcttaggaaatgctcatggctggggagatgagtggtatgctgtaaatgccagaggcagatcagaaaaggaatgaaccggattccccacggggtgtcaggcagttcctatgagtgatcctaattggtctgctgatgaaaaggataaagacaattgtcataggattcattttattacttgtatagttgagggactaaaaactgcatgagtaaaacccattaactactccaaactattggaggtttgtcaaggggaacaagagcgttcatcagctttcttagaaagtctcagacaagcagtgagaaagcatacagcaatggacccagaatcaatggagggccaaataattcttaaagacaaattgataactcaatcagcaccagatatatggagaaagctccaaaaattggcttttggccctgatcaggacctggagcacctccttagagtagcaactcgagtgtattataataggggccaggaagaatgaaagggaagaaaaagaggagaaacagagaagagtttgaggctctagttatagcactacagggaatcagcctgggagcttccaaggcgagaggattatggtagagacctaagcccagagtctgtttcctctgtggaaaagagggacaatttaaatgagaatgccccaagactcagaccccagcatgtaggccttgtctcatatgttggggagatcattggaaaaggggactgcccctgaagatgaaggtctctggagttgatccctcaggcccgggatcaagactgacaggacccgcagctttccacattggctcctgcccttatcaccactcgggagccccaggtggctctaaatgtaggaggacagactattgacttcctcctggttacaggagctgcctttttgtcccttctctccaaacctggggcccatcaaataaatctgccactattcatgttatttctggcaagccagttataaattctttacatgacctttgagttgtgactgggagtccattttcttctctcatgcctttctgattattccagagagtcgaacccctcttttaggaagagatattttgtcaaaggttaaagcctcaattcacatgaccatggaacctaatcaaggtttatgcctacttttaatggaagtagatgtttacccagaagtctgggccataggagaaaagatagggagagcaaaaaaaaaaaaatgctcaactggtggaaataactcttaaagattaaaatttatttcctcaccaaaagcggtatcctctgagactgaggcatgacagaagacttatcccaattataagaaacctaaagggacagggactattaattgaatgtaacagcccttgtaaccaccctatattgtgagtacaaaagcctagtggggattgatgcctagtgcaagatcttcatctagtaaatgaggcaatggtcccattacatccggtggtgcccaacccctacgctctcctctcacagattccagaaacagcatcctggtttactgtattaagtttaaaagatgcctttttctctcttcccttagctaaggcttcacaatttgtatttgcctttgaggatccctcagattcatccacacaactaacttggactgtcttgcctcagggatttagagacagccctcatttacttggacaagcattagccagagatttggcaaacgttaaggcttctaagccggttaaaattattcaatatttggagaacatttttgtctgtgctgatactgaagaacaatgtaaagcaactttcaattatatgctgaccaaggaaagagcatatatttcatggccaaacaaatatttcatggccagccagagaaatcagaagaatcatacaggttagaggtatttaatcaattttatcaaatatgggatcaaaatatacagatcactcctgaaaagggttatttaacccaacctacatctatttgctgggagcaaaataaacacgtcagatttggtaggtgacccatatcctctaatgagctaaaatctttaggatatttaccaactgaacattgttcaccaatcacccaggtcacatataatccagataagactcccatatggcctggaacggactggggatctaatcctggactatgttggctatccccaagtggaaacttattggatatgtggaactcatctgtggccttgactacccccaagatggataaggcgctgcactctggggttggcttctgctcatggcaacatgatgaaaactctgaggcaaacaccagccaaccttccctatttacatgctagacgggccagatcagtgttccactggtatgattacttagtatcaatatttgtaacttcattaggaactactgacataatgctgagggtggaagccttaactaattttactcaatgaactcttaacggtactgcagaagctattcctaccccaaacatggaacaacaacaaataagaaaagcagtgctatgaaaccgaatggccttagatacacccactgcagctcaaggaggtacctgtgctattataaaatctgaatgttgtgtctgtattcctgattattcacagactgtgtctgattccatgaaaggtctctggcagcagattcataagatttctgatccacatccaggctttggagctgccatctggaactggttgacctcctcctcctggtggaaatatttgctcaacatggtcatcattgtgatcttgatccttttattcagcccgtgtataattaattgtatttctcactttattacatccctattaagagctatcaaccttcaaatggaggtagaagaggtacccaatgtcatgtatagaagcccactcaaccatcccatgaaaggagacctaactgcttcttcctaatgacaccccttgtcagcaggaagcagagtggtcattgccccttttcccccacagttagagtctccaattctagaaggggggattgaggcagaacagtaactcaggtagtcagtgtagaagcatgggctttgatgcattctttgatatggctattgattaacatttgtgcccataagggctccagggaataacgtccccacaggccttgtttactgcagagggtgtacctatgcccagatggacattaatatcgaaccccctgtgactcagtctacaggaagagaagggcaaagaaaccatgagacctatggggagtttccatccataagaccccaattggacaaggactgatataggtaactgggcaaggccaatgggagaaaaccacatctttctggaccccactttggtaacccccatttttaagggataaaaacctatataggacaatagagagaggaactcttcatccccctcccagctttcctcagagctgtttgctttcctgtaataaagactttgcctgcttgtaataaataaataaataaatatataaataaatgcctagggataaacttctgaaggaggcaaaacttatgctctgaaatctataagatgctgttgaa

SEQ ID NO: 57 - DNA, 8561 bp, Artificial
  ss445 sequence
tgcttggggatgggggaggtccgggagacttacatgggaaaattaagaccttgtagtgtataaaagttactgagaacaaagacctggtgctcagactctggaggtgactcctctgagcccgcactggtgctgaataaaccttgcttttccatatctccaagtgctgtttgtctccttccattgccacagtttttgcagtttccgcaacattttggtgcattggccgggaagccgacaaccgagctggcctcttgtgccaccattgtcggggaaccgggggaggccacggtcgccagcccagtgacagttggatagcacgcaccggccattttgtcagatccagaccctcactcgggccatggccttggcccacaccatttcccgaatggactcagaaggaaagtggaaacaggtccctggacaggacgtcagactagtgagtgccccggggacatctgcccaagttaggacctgccatacagcggaaggagagactgatcacctttcagtgaccaaagggtcactcaggtcagggtttgctcccttgggatcgggaggcttgtcaattctggtgtgtgtgtgtgtgtgagtgactggagagaatgagagcccatgctccaccatctttggactacggagccagagtgagtcctaacctgcagttccgcggcgaccctcatacggcttatggtggccctctttggggggatcctgacgttggggtttatacagtcccacctatgctaagaggtacctgaaatatctcctccaggggagcggtcaggcagacgaagcgattgttacctgaggccttgtcctcactgtttgtcttgcgtcaccggcacagggtgggacttcacacaatgggtaaatcagcttccaagcccactgtcttaaagtgtacggttaagaattttaagaaaggattttctagagattatggtgttaaactgagtcctggaaaactgtgtaccctctgtaccctagagtggccctcctttggtgttggctggcctccggaagggaccttagatgtgttcacagttacagcagtatataatgttataacaggagaccctggacacccagaccaatttccgtatattgatcaatggttggaaattgcctatttgaggcccccatgggttcggttctgcaccacagactacggacagtgtagggtgctagtagcccagtccaagaagaaaaccttgtctcaaaagaaggtgccacctatttatcaaggggaacctgaggacttgccccctatgccaccaccttatgtgctgctggccccacctccaggaaccgaaggtccccagatgccagatagcccaccaccttctgtttctcctcctccttctgcttctgaagttcctgaggcgatatcacccccgcagccagattctccagaacctatgagcaggtgtctctggtcagctcagggagcagccactccagcattgcaaatgcccctacgggagacacaggaaccacagcaagtcgcccccgatgggaccataaaagaggggggatgtttttattatttccagcccttttccactgccgatctccttaactggaaacaccatactccctcatattctgaaaagcctcagacgctgatgatctcttggaattcattttccagacacactgtcccacctggatagactgccagcaactcctttttactctatttgacactaaagagcactggtgaattgtaacagaagcccaaaaatggtttcaggccaatgcgaggggtcgaacagacttgacaaactgggtaagaaaagccttcccaaaagaaaacccccactgggactatgacactaaagaaaaaaaacataacctagagaagtaccggcaggccttcctacaggggacaaaagctggggctaaaaagcccactaatatagctaagatcagtgagatactacaagagccaaatgaaagcccagccaaattctatgagagactatgtgaggctttctgaatctacaccccttttgatctcgaggcccctgagaaccaacggatgataaatgctgcctttgtgggacaagcccaatcagatatctgtaaaaagctacagaaattagaaggatttgcaggagagaatccactaaactgttgaaaatagccaacaaggtttttattaaccaagaccaggtgggccgctgtgatgcagaaaagagaatgaaacaaaaagtgacacttctggtagccgccctgtcaaaaccggtgcacccagtgggaccaccccataggggacaaggcacaaggccagggaaaagtagtctcctggaacatgaccaatgtgcttactgcaaagaaaagggacattggaaaaatgaatgtcccaaccgtcctgagaaaaagaccaaggccccaccaaccggtactgatctgggccattcagcaccaacctgatcatcctagctgagtctgattaggggggaccaggctctctccaactgggcccccgagagcctatggtcagaattcaagtagggggccaccccatagactttatggttgacacaggtgctgaactttctgtggttacacaacctgtggctcccctcttggggaaagaaaccaccattgttggggccacaggtaactaaacccacaggtccttctgcggtccttgatgatgtcggttaggaggccatgaagtaatacatgaatttctttacctgcctgactgcccagtccccctaatgggaagagacctgctggctaaaatgggggcacaaatttccttttctactgacggattggcccaacttaaattgacagaacccccctctcctttaatcatggctcttgctgtaaaaagggaagtggaatggcgcttgtactcttccccttcagaaatgggaaccattcccccagaactagagactaaatacccattggtttgggctgaaggaaacccaccaggactggcaaaacaccacactcctgtcttaattgagctaaaacccagagctcaaccggtaaagctacggcaatactcaattcccagagaagctcgactgggaatccaggttcacctggataggctgcttcagcacggactgttaataaaatgtcagtccccttagaacacccctttactgccagtgaaaaaactgggaacacaggactactgcccagtacaggagttgagagccataaataaagcaacagtcacattacacccatccgtccctaacccatataccctgctagggctgaccccctccactgctgagtggtttacttgcctggacttaaaagacgcttttttctgcctctgggtggcacctgccagtcagcccttgtttgcttttgaatgggagaatccacctacagggacaaaggaacagctcacctggactagactcccacaaggattcaaaaactctcccactctttttagcggtgccttagctgctgacctggctaaatttcctggacaaaaactgggctgtgttttgctacagtatgttgatgacctcttactagctggcaccacggagactcagtgcctagagggaacaagagctctcctttccctactgatggaggcagggtatcgggtatcaaagagaaaggcacaaatctgcaaaaaacaagtcaggtatctgggcttcaacatcatgcagggtctatgaatgctggggactgaaagaaagcaggcagtttgtgccattcctgtccctaccacccgccggaaggttcgtgagttcctaggggcagcaggattctgctggatatggatccccgggttttcagacctggccagacctctgtatgaggctctaaaaggggaagaaaaggctccccttgaatggggaccaaaccaggagacagcatttcagacaatcaaaaccaaactcactgaggctccagccttgggacttcctgatgtaaccagagaatttaacctttttgttcatgagaaaaatgggatggctttgggagtcttaactcaaaaatttgggccttggcagaggccagtgacacatctgtctaaacaaattgactcagttgctgccagatggcctctctgcctccgagcgctggcagctaccaccttgttggtaagagaggctgacaagttgaccctgggacaaaacctcaatgttaaaatcccacactcagttgtaaccctaatggatacggggggccaccattggctcacacatgcacgaatgactcaatatcaagggttacatgtgaaaatccaagggtaaaattggaggttgtacgaactctgaacccagctacttttctgccagatgaagcagggcccccagaccataactgcctggaggtactagatgaggtgttttccagcaggcctaacttgactgataaacccctccaaaatcctgacctggttttatatactgatggcagcagctttatggaggatagaaaaaggatggcaggatatgctgtggtatctgacttaaaagtgatagaagcagaggtgcttcctcaaggctggtcagcacagagagcagaattatgggtcttaatcagagcactggaactcagctgagaccagcgagttaatatctataccaactcatgatatgcctttgcaactttacatgtccatggagccttatataaagagagagggctcctcactgctgaaggaaaaggaattaaaaactaggctgaaatcttaaagctcctagaggcagtatgggaacctaaagaagttgcagttacccactgtaaaggccaccaaaagggggatgacccagtgacaaaaggaaaccgtagtgctgatgcagctgccagacaggcagccctgggacaacagccagacaaacctaaggtcttgctggccccaaaagtgccagctgtccccaaatattctccagaggaagaaaaatggataagggaggaaggaggaactaaaactaaaacggggtggtgggtcacacgggaccaccgagtttacattccagaacagctggcctacaaactagtcctccaagaacatgagctaacccacatgggcaaaactgccttagagaccctactgggccggtactatctcattgctcatcttcctgcactctgctcctctgtctcccaaagatgcagaaactgtttacagaataatgcccatcaggggccccacagaccagctggggcacagcactgcagactgtccccatttgaggatatggaagtggactttactgaggtcacccctagtaaggggtacaaatatttactagtttttatctgtattttttcaggatgggtagaggccttccctacccaaactgaaaaggcaagggaagtaaccaaggcactcctgagagacattattcccagatagggaatgcctctgaccatcgggtcagataatggaccggcatttgtggccgaaacagtacaacaggtggcaaaagctttacagatctgatggaaactacattctgcttatcgccctcaaagttcagggaaagtagaacgcatgaaccgaacccttaaacagaccctggcaaagttatgtcaggaaactggcttgccctggataggcatgttgccggtggccctcttaaaagtgagatgctcaccccaagcgggaataggattctcgccatttgaaatcttatttggaaggccacctcaactaatcagtttaaaaggaaacaccagggagttgggaattacataaacaattacaaggactggggctcactatttctcggatacatagatgggtcacagaatacctgtgtccttaggtgtaacagtacacccccacaagccgggggaccaggtgtagataaaggactggaaaaaggagcctttgaggccagtatggaagggcccctatactgtaattctaaccacccccactgctcttaaagtaataggaatagatgcttggatccatcattctagagtaaaaccagctggcccagctgacaaccatggagagtgggagacggccctcaatccagagagacctcttcgcctgacaatacagagaaggagacaatgatctcaaagccctgctctgaccacactggaagctggtcagtcaacgcacggctgaagcttgaggaatcggcagcctgttaaaataaactgccttacctcccttccacaagagactctctaactgccatatactgttatcttatgaccaacatgtatgtttgctgcctgttgctgttaatctggtccccttttggtctgccaggatccatgtcctcatgtgacccatgcattcgagtgatccgatcagatcaaggggttacatggactttgctttactccactcatttctcctgttctggagaaattcatggaagttgtactcacaacaggaccacttattctatctgtcaacagggggaccaatatacttgctttgatccacgatactcaccaactgaggaatggttagaagtccagcgctctcataaatcagggcagctaattaatcagacccaaattaccaaccccaatttgccagtatcaatatttgttgatgcctgtgaagctatgaatgggtcatggacttctactagaccatgtggaagcccatcatgggaaagaaaatataggctccagcataaatatatgtgctgggggaccacctggagtggttgccataaatgcacttactggagctgcgtggcctgggcaacctggaataagggagacaaaacagctgtccttcaaaagggtacagcccctccagactgccagactaaagcttgtaacccagttaatttcactattttcaattccagtgagcccaaatggaaggagggtttcaaaataagcattcgcattgacggaagaggccttgaccctggagctgtgctacatttccagagaatcacgtttgcgctccaagctgcctctcacagcatctttcattccttttacgaagagataagaaacaccccacctcccattctggccacaactaagaacttgttcttagccctggcagaaactattgcacaaacatactctatgtatgtgggggaactaacacaggagaccactggccttggcaagccagagaactggacccattagagcctcataatgaggctcaccaatggggcatggctcctcaaaactgctattatagggaaaaattgtcttgcgaggcggggaggatggtttaatgtttcagttggaagcctaacatgtttaggcctaaggtattataatctgactgcccgaaagactcagtggtggtcatcctccaatttctcagagcccaaacctaatccttcatctaaattttccctcctttgacaagcatggaaatatatcagtgctaatatccagtggtgggcaccaaagggattatattgaatttgtgaaaaaatggcctattccatactctcccccaattgggctggggcatgtgtactgggaacaatcagaccttccttctttctgctcctgctgtcactaggggagcaactgggagttcctatatatagggcacagggtgcccagagagaccggagggctctccaaattggagactggaaagatgatgaatggcccccagaatggataattcaatattatgggcctgccacctgggcagaggatggctcttggggatatcacacccctatctatatgctgaaccacatcatcagactacaggcggttttggaacttataacaaatgacactgcaagggccttgactatattggcccaacaacaaattaaaatgcacagtacaatctaccaaaattgcttggccttagattatttacttgcttctgaaggaggggtttgtggaaaatttaacttaagtaattgctgtctacaaatagatgacactggaaaggtggtaaaaaaaaaaattgctgaccgcatgaataaactagccatgtacctgtacaaacttggaaaggatgggatgcagacagtctttttggtaaatggttctcttggttgggagaaattaagacaatggtcagaataatcatggttatactcgcagggtgcctacttattccctgcctgtacctctcctgataaatattataaaagattttataagaaccatggttgaaagaaaaacagcctcccacctgctacttattagaggctaccaaagggtcatgactgatgatgatctgtaaagggtgcagatgcaccctgaacatcaagaggggggaatgaaatggagttttaactaaagaacaacccccccccccggctaagctgtaaacctttccagctgtgctaatcactatgccacccttcttgtaataatgtaacaactgtgcactctctgtccaagccagcagccctgctaatcaggtacccagcattgcttatcagttccgcttctgtaaccttgcttgctcagtttcttagagaggaacactatctgcttggggatgggggaggtccgggagacttacatgggaaaatcaagaccttgtagtgtataaaagttactgagaacaaagacctggtgctcagactctggaggtgactcctctgagcccgcactggtgctgaataaaccttgcttttcca

SEQ ID NO: 58 - DNA, 7004 bp, Artificial
  ss447 sequence
aagaagaaaaccttgtctcaaaagaaggtgccacctatttatcaaggggaacctgaggacttgccccctatgccaccaccttatgtgctgctggccccacctccaggaaccgaaggtccccagatgccagatagcccaccaccttctgtttctcctcctccttctgcttctgaagttcctgaggcgatatcacccccgcagccagattctccagaacctatgagcaggtgtctctggtcagctcagggagcagccactccagcattgcaaatgcccctacgggagacacaggaaccacagcaagtcgcccccgatgggaccataaaagaggggggatgtttttattatttccagcccttttccactgccgatctccttaactggaaacaccatactccctcatattctgaaaagcctcagacgctgattgatctcttggaattcattttccagacacactgtcccacctggatagactgccagcaactcctttttactctatttgacactaaagagcactggtgaattgtaacagaagcccaaaaatggcttcaggccaatgcgaggggtcgaacagacttgacaaactgggtaagaaaagccttcccaaaagaaaacccccactgggactatgacactaaagaaaaaaaacataacctagagaagtaccggcaggccttcctacaggggacaaaagctggggctaaaaagcccactaatatagctaagatcagtgagatactacaagagccaaatgaaagcccagccaaattctatgagagactatgtgaggctttctgaatctacaccccttttgatctcgaggcccctgagaaccaacggatgataaatgctgcctttgtgggacaagcccaatcagatatctgtaaaaagctacagaaattagaaggatttgcaggagagaatccactaaactgttgaaaatagccaacaaggtttttattaaccaagaccaggtgggccgctgtgatgcagaaaagagaatgaaacaaaaagtgacacttctggtagccgccctgtcaaaaccggtgcacccagtgggaccaccccataggggacaaggcacaaggccagggaaaagtagtctcctggaacatgaccaatgtgcttactgcaaagaaaagggacattggaaaaatgaatgtcccaaccgtcctgagaaaaagaccaaggccccaccaaccggtactgatctgggccattcagcaccaacctgatcatcctagctgagtctgattaggggggaccaggctctctccaactgggcccccgagagcctatggtcagaattcaagtagggggccaccccatagactttatggttgacacaggtgctgaactttctgtggttacacaacctgtggctcccctcttggggaaagaaaccaccattgttggggccacaggtaactaaacccacaggtccttctgcggtccttgatgatgtcggttaggaggccatgaagtaatacatgaatttctttacctgcctgactgcccagtccccctaatgggaagagacctgctggctaaaatgggggcacaaatttccttttctactgacggattggcccaacttaaattgacagaacccccctctcctttaatcatggctcttgctgtaaaaagggaagtggaatggcgcttgtactcttccccttcagaaatgggaaccattcccccagaactagagactaaatacccattggtttgggctgaaggaaacccaccaggactggcaaaacaccacactcctgtcttaattgagctaaaacccggagctcaaccggtaaagctacggcaatactcaattcccagagaagctcgactgggaatccaggttcacctggataggctgcttcagcacggactgttaataaaatgtcagtccccttagaacacccctttactgccagtgaaaaaactgggaacacaggactactgcccagtacaggagttgagagccataaataaagcaacagtcacattacacccatccgtccctaacccatataccctgctagggctgaccccctccactgctgagtggtttacttgcctggacttaaaagacgcttttttctgcctctgggtggcacctgccagtcagcccttgtttgcttttgaatgggagaatccacctacagggacaaaggaacagctcacctggactagactcccacaaggattcaaaaactctcccactctttttagtggtgccttagctgctgacctggctaaatttcctggacaaaaactgggctgtgttttgctacagtatgttgatgacctcttactagctggcaccacggagactcagtgcctagagggaacaagagctctcctttccctactgatggaggcagggtatcgggtatcaaagagaaaggcacaaatctgcaaaaaacaagtcaggtatctgggcttcaacatcatgcagggtctatgaatgctggggactgaaagaaagcaggcagtttgtgccattcctgtccctaccacccgccggaaggttcgtgagttcctaggggcagcaggattctgctggatatggatccccgggttttcagacctggccagacctctgtatgaggctctaaaaggggaagaaaaggctccccttgaatggggaccaaaccaggagacagcatttcagacaatcaaaaccaaactcactgaggctccagccttgggacttcctgatgtaaccagagaatttaacctttttgttcatgagaaaaatgggatggctttgggagtcttaactcaaaaatttgggccttggcagaggccagtgacacatctgtctaaacaaattgactcagttgctgccagatggcctctctgcctccgagcgctggcagctaccaccttgttggtaagagaggctgacaagttgaccctgggacaaaacctcaatgttaaagtcccacactcagttgtaaccctaatggatacggggggccaccattggctcacacatgcacgaatgactcaatatcaagggttacatgtgaaaatccaagggtaaaattggaggttgtacgaactctgaacccagctacttttctgccagatgaagcagggcccccagaccataactgcctggaggtactagatgaggtgttttccagcaggcctaacttgactgataaacccctccaaaatcctgacctggttttatatactgatggcagcagctttatggaggatagaaaaaggatggcaggatatgctgtggtatctgacttaaaagtgatagaagcagaggtgcttcctcaaggctggtcagcacagagagcagaattatgggccttaatcagagcactggaactcagctgagaccagcgagttaatatctataccaactcatgatatgcctttgcaactttacatgtccatggagccttatataaagagagagggctcctcactgctgaaggaaaaggaattaaaaactaggctgaaatcttaaagctcctagaggcagtatgggaacctaaagaagttgcagttacccactgtaaaggccaccaaaagggggatgacccagtgacaaaaggaaaccgtagtgctgatgcagctgccagacaggcagccctgggacaacagccagacaaacctaaggtcttgctggccccaaaagtgccagctgtccccaaatattctccagaggaagaaaaatggataagggaggaaggaggaactaaaactaaaacggggtggtgggtcacacgggaccaccgagtttacattccagaacagctggcctacaaactagtcctccaagaacatgagctaacccacatgggcaaaactgccttagagaccctactgggccggtactatctcattgctcatcttcctgcactctgctcctctgtctctcaaagatgcagaaactgtttacagaataatgcccatcaggggccccacagaccagctggggcacagcactgcagactgtccccatttgaggatatggaagtggactttactgaggtcacccctagtaaggggtacaaatatttactagtttttatctgtattttttcaggatgggtagaggccttccctacccaaactgaaaaggcaagggaagtaaccaaggcactcctgagagacattattcccagatagggaatgcctctgaccatcgggtcagataatggaccggcatttgtggccgaaacagtacaacaggtggcaaaagctttacagatctgatggaaactacattctgcttatcgccctcaaagttcagggaaagtagaacgcatgaaccgaacccttaaacagaccctggcaaagttatgtcaggaaactggcttgccctggataggcatgttgccggtggccctcttaaaagtgagatgctcaccccaagcgggaataggattctcgccatttgaaatcttatttggaaggccacctcaactaatcagtttaaaaggaaacaccagggagttgggaattacataaacaattacaaggactggggctcactatttctcggatacatagatgggtcacagaatacctgtgtccttaggtgtaacagtacacccccacaagccgggggaccaggtgtagataaaggactggaaaaaggagcctttgaggccagtatggaagggcccctatactgtaattctaaccacccccactgctcttaaagtaataggaatagatgcttggatccatcattctagagtaaaaccagctggcccagctgacaaccatggagagtgggagacggccctcaatccagagagacctcttcgcctgacaatacagagaaggagacaatgatctcaaagccctgctctgaccacactggaagctggtcagtcaacgcacggctgaagcttgaggaatcggcagcctggtaaaataaactgccttacctcccttccacaagagactctctaactgccatatactgttatcttatgaccaacatgtatgtttgctgcctgttgctgttaatctggtcccctttggttctgccaggatccatgtcctcatgtgacccatgcattcgagtgatccgatcagatcaaggggttacatggactttgctttactccactcatttctcctgttctggagaaattcatggaagttgtactcacaacaggaccacttattctatctgtcaacagggggaccaatatacttgctttgatccacgatactcaccaactgaggaatggttagaagtccagcgctctcataaatcagggcagctaattaatcagacccaaattaccaaccccaatttgccagtatcaatatttgttgatgcctgtgaagctatgaatgggtcatggacttctactagaccatgtggaagcccatcatgggaaagaaaatataggctccagcataaatatatgtgctgggggaccacctggagtggttgccataaatgcacttactggagctgcgtggcctgggcaacctggaataagggagacaaaacagctgtccttcaaaagggtacagcccctccagactgccagactaaagcttgtaacccagttaatttcactattttcaattccagtgagcccaaatggaaggagggtttcaaaataagcattcgcattgacggaagaggccttgaccctggagctgtgctacatttccagagaatcacgtttgcgctccaagctgcctctcacagcatctttcattccttttacgaagagataagaaacaccccacctcccattctggccacaactaagaacttgttcttagccctggcagaaactattgcacaaacatactctatgtatgtgggggaactaacacaggagaccactggccttggcaagccagagaactggacccattagagcctcataatgaggctcaccaatggggcatggctcctcaaaactgctattatagggaaaaattgtcttgcgaggcggggaggatggtttaatgtttcagttggaagcctaacatgtttaggcctaaggtattataatctgactgcccgaaagactcagtggtggtcatcctccaatttctcagagcccaaacctaatccttcatctaaattttccctcctttgacaagcatggaaatatatcagtgctaatatccagtggtgggcaccaaagggattatattgaatttgtgaaaaaatggcctattccatactctcccccaattgggctggggcatgtgtactgggaacaatcagaccttccttctttctgctcccgctgtcactaggggagcaactgggagttcctatatatagggcacagggtgcccagagagaccggagggctctccaaattggagactggaaagatgatgaatggcccccagaatggataattcaatattatgggcctgccacctgggcagaggatggctcttggggatatcacacccctatctatattctgaaccacatcatcagactacaggcggttttggaacttataacaaatgacactgcaagggccttgactatattggcccaacaacaaattaaaatgcacagtacaatctaccaaaattgcttggccttagattatttacttgcttctgaaggaggggtttgtggaaaatttaacttaagtaattgctgtctacaaatagatgacactggaaaggtggtaaaaaaaaaaattgctgaccgcatgaataaactagccatgtacctgtacaaacttggaaaggatgggatgcagacagtctttttggtaaatggttctcttggttgggagaaattaagacaatggtcagaataatcatggttatactcgcagggtgcctacttattccctgcctgtacctctcctgataaatattataaaagattttataagaaccatggttgaaagaaaaacagcctcccacctgctacttattagaggctaccaaagggtcatgactgatgatgatctgtaaagggtgcagatgcaccctgaacatcaagaggggggaatgaaatg

SEQ ID NO: 59 - DNA, 4851 bp, Artificial
  ss453 sequence
tggtgcattggccaggaagctaacaaccaagctggcccctttgccactgttgttggggaactggggaaggtcatggttgcaggcatggtgacaggtggatagtgcatgccagctgttttgccggatcctaactctcactcaggccatgctggccctggctcacgccactgcctgaacggactcagggagagtggaaacaggttccaggataggaggtcagactggtaagtgccccaggaacatctgcccgagtcaggacccaccatatggtggaaggagagtctgatcagatctgtgaccagagggtcactcaggacaggatttattcccttgggatcgggtggcctgtcaattctggtgtgctgtgtgtgagttattgcggtgaaggagagcccatgctccaccaacttcagactgtggagcctgagtgggtcctgacctgcagttctgtggtaacctcatatggactttaaggctgtgccaggctctgagggttctcttctcttcctgcgagactggtctgggtctgggatttatacggatcagccacatgccaagcggcacctttaacctctgataggggggtggtcaggcagacaaaagtgagtactcccctactgtttgtcttgtgacatcgtcacagggtgggaattcacacagtggtgaatcagctttaaaacccgctgtcttagaatgtatggttaagaattttgagaaggattctctggagattgtggtgtgaaactgaatcctggaaaactgcactctctgtagcctagagtggccctcctttggggtcagatgaccctcagaagggaccttagatgtgcccacatttcaagcagtatataatgttatatatagcaggagaccctggacacttagaccaatttccatacattgatcaatggttaaagttgccccgttaaggccaccctgggttcagttctgcgtcacagaccagggacagtgcaaggtcctagaagtccagtccaaaaagaaaactctgccttgagaaaaggagcccccacagacatgatcaatgtgcctactgtaaagaaaaggaacactggaaaaatgaatgccccaaccgtcctgagagaaagaccaaaatgtcacccccacctagccaatactgacccaagccacctagcttgaatctaatgggcttagctgaagaagaatctgactgggggggaccaggttctctccaaccaggcccccaagagcctatggtcagaattcaagtagggggccattctgtagactttacggtagatacaggtgctgaacattcagtggtcatacaacctgtggctcccctcttggggagagaaactaccattactggggccacagatacccaaacccacagtccttctgtggtcctagatggcactggttaggagccatgaagtagtatatgaatttctttacctgcctgactgcccggttctcctgatgggaagagacctgctggccaagatgggggctcaaatctccttctccacagatggatcagctcaactcaaatgaacagaaccaccctcttctttactcatggctctcactgtaaggagggaagaagaatggcacctgtactcttcccctccagaagaggggaccagtcccccagaactagagactgagtacccactggtttggggtgaaagaaaccctctgggactgcaagatgccatgctcttatcttgattgatctgaaacctgcagttcaactggtaaagctgtggcagtacttgattcccagagaagcttaactgggaatccaggctcacctggataagctacttgagcatggacttttgataaagtgtcagtcaccctgcaacaccctctcattgcctgtaaagaaactggggatacaggactaccacctggttcaggacttgagggtcataaaggaggcaacaatcacattgcacctgtctgtgcttaaccagtataccctgctggggctgatcccttctactgctaagtggttcacttgcctggacttaaaatatgccttcttctgcctctgagtagcgcctgctagtcagcccttgtttgcctttgaatgggaaaatccacacactgggacaaaggagcagctcacttggacaagactcccacaaggattcaagaactctcctactcttttcagtggggccctggctgctgacctggctgaatttcctggacaaaaactagactgtgtcttgctacagtacattgatgacctcttgctggccagcaccacacaggctcaatgccaaaggaacaaaagctcccctctccctactaatagaggctgagtattgggtatcaaagaaaaaggcacaaatctgtaacaaacaagtcaagagtctgggcattaacatcatgcagggctgatgaattccggggactgaaagaaaacatgcagtttgtgctattcaagtccctaccacccatcagaagattcatgagttcttaggggcagtgggattctgaaggatatggatcctcaggttttcagacttggccagacatccatatgaagccctgaaaggagatacaccgacttacgaaaagtggatacaagaggaaggagaaacccaaacaatgacaggatggtgggtcacataagactgctggatttgtgttttggaacagctggcctacaaactagtctaccagctacacgaactgacccacatgggcaaaactgccttagagaccttactggatcagtactatcttattgcatgttttcccgcactctgctcctccatctcctaatggtgcataactcgtttgcaaaataatgcttgctaggggcctaaaagaccagctgggacacaacactgtgtggactgtccccatttgagaatatggaagtggacttcacaggggatacaaatacctgctagtttttatctgcaccttttcagggtgggtataagccttcccaacccaaactgaaaaggcaagggaagtaaaccaggcactcctgagagacatcattcccagatacggaatgcctctgaccatcaggtcagacaatggaccagcatctgtggccgagtcagtgcagcaagtggcaaaagccttacagatctggtggaagctgcattctgcctattaccctcaaagctcagggaaagtagaacacatgaactgaacccttaagcagactagcaaagttatgtcaggagactgcattgccctgggtagatgtgctgctggcagccctcctaaaagtgagatgctcacccagagtgggaataagattctcgccatttgaaatcttatatggaagaccacctccaccgatcagtttgagaggaaataccagagaattcggagacttagatttacataaacaactgcaaggattgaggctcactatctcacagatacacaagtgggtcacagatagaatacctgtatctttaggtataacgatgctcccccacaaactgggggactaggtgtggataaaggactgggaaaaagagactttaaagccagtatggaacgggccctatactgtaatcttaaccacccccaaagccctcaaataacaggaatagacgcctagatccatcactccagagttaagtgcaactgatgactgcagggaatggagagctgcccttgatctggagaaacctctacacctgacaatacagaggaggagataacaatcttaaagctctgctctgaccacaccggaagctggtcagtcagtgcacagctgaagcttgaggaattggctgtccagtgatgtttcttgtttgtagttattaatccggttccccttgaccctgtcaggatccattctgatccgtgcagatgcaccctgaacctcaagaggggggactgaagtaagactttcaactaaaaaaacaaccccccccagcagggaaggcatctatgtgcaggagaggagcttggctcaccccataccacccttcttgtaatcttgtagcaattacatgccttgtgtccttgctagcaactctgctaacagtgctcccagcattgcttatcagtttcctttttgtaatcttacttactcagcttcttaggcaggaacactgtctgcttgcaggagggggagggccaggctgctagtgtgggaaaaacaagtcccataaatctgtattataaaaatctacccagaacaaagacctggtgcccagactctggagggggactcctctgagcctgcactggtactgaggaaacctggctattccacatctccgagtgccatttgtctctttgcgctgccatggcttctgcagcaccacagctcacatcacactctatgataaaagttgaaagctttttctcaaaaaacatgagtaagactagaggggccatatcgacattcctattcaacatagttctggctgttctagccacagcaattagccaaggaaatagtctcttgcttacacctgccattatcagtaactgatgtttcccttttactttcttgctaaagcatcacttgaattatctaaagggtcttatgttgatttgaacatcagtttgtcctaaccctttaggtccctcagaacaatagtctggaaaaacaaccatgagcaaggacacccatcatggacacaggatgacagatcctctttgtcagcatggatttgtctcttccacacctcccactctgcctccatttcaatgtcttgtcatcacactcatgatgaaatcatagaggtaaggggaaaaacatgtttttccttgtttctcattgggatggaggaagacaggtgcagatcccaggacaggcgcctccccagaggtgctccatggaactgatattaagcagtaaaaagaaggagaagc

SEQ ID NO: 60 - DNA, 4973 bp, Artificial
  ss458 sequence
tggtgcgttggccgggaaaccccgcgaccacccctcacacccaagaaccgacttggaggtaaagggatcccctttggaatgtgtgtgtgcgtgccggccggcgtctctgttctgagtgtctgttttcggtgatgtgcgctttcagtttgcagctgtcctctcagaccgtaaggactgggggactgtgatcagcagacgtgctaggaggatcacaggctgccaccctgggggacgccccgggagctggggagagccaaggacgcctggtggtctccttctgtcggtcagaggaccgagttctgttgttgaagcaaaagcttccccctccgcggccgtctgactcttttgcctgcttgtggaaggcgcggacgggtcgcgtgtgtctggatctgttggtttctgtttcgtgtgtctttgtcttgtgcgtccttgtctacagttttaatatgggacagacggtgacgacccccccttagtttgactctcgaccatttggactgaagttaaatccagggctcataatttgtcagttcaggttaagaagggacctttaattctgagattatcctggctgttaaagcaaatatttttcagactggacccggctctcatcctgatcaggagccctatatccttacatggcaagatttggcagaagatcctccgccatgggttaaaccatggctaaataaaccaagatagccaggtccccaagttctggctcttggagagaaaaacaaacactcggctgaaaaagtcaagccctctcctcatatctaccccgagattgaggagccgccggcttggccggaaccccaatctgttcccccacccccttatccggcacagggtgctgcgaggggaccctctgcccctcctggagctccagcggtggagggacctgctgcagggactcggagccggaggggcgccaccccggagcggacagacgagattgcgacattaccgctgcgcacgtacggccctcccataccggggggccaattgcagcccctccagtattggcccttttcttctgcagatctttataattgaaaatctaaccatccccctttctcggaggatccccaatgcctcacggggttggtggagtcccttatgttctctcaccagcctacttgggatgattgtcaacaactgctacagacactctccacaaccggggagcgagagagaattctgttagaggcttaaaaaaaaaaaaaaaaaatgttcctggggccgacgggcgacccacacagttgcaaaatgagattgacatgggatttcccttgactcgccccattgggactacaacacggctgaaggtagggagagcttgaaaatctatcgccaggctctggtggtgggtctctggggcgcctcaagacggcccacaaatttggctaaggtaagagaggtgatgcagggaccgaacgaacctccctcggtatttcttgagaggatcatggaagcctttaggtggttcaccccttttgatcctacctcggaggcccagaaagcttcaatggccctggccttcataggacaggcagctctggatatcagaaagaaatgtcagagactggaagggttacaggaggctgagttacgtgatctagtgaaggaggcagagaaagtgtattacaaaagggagacagaagaagaaagggaacaaaaaaaagcgagagaaagagaggaaagggaggaaagacgtaataaacggcaagagaagaatttgactaagatcttggctgcagtggttgaagggaaaagcaatagagaaagagagagagattttaggaaaattaggtcaggccctagacagtcagggaacctgggcaataggaccccactcgacaaggaccaatgtgcatattgtaaagaaaaaggacactgggcaagggactgccccaagaagggaaacaaaggactgaaggtcttagctctggaagaagataaagactagggaagacggggttcggaccccctccccgagcccagggtaactttaaaggtggaggggcaaccagttgagtttctggttgataccggagcgaaacattcagtgctactacagccattaggaaaactaaaagataaaaaatcctgggtgatgggtgccacagggcaacgacagtatccatggactacccgaagaacagttgacttgggagttggacgggtaacccactcgtttctggtcatccctgagtgcccagcacccctcttaggtagagacttattgaccaagatgggagcacaaatttcttttgaacaagggaaaccagaagtgtctgcaaataacaaacctatcactgtgttgaccctccaattagatgacgaatatcgactatattctcccctagtaaagcctgatcaaaatatacagttctggttggaacagtttccccaagcctgggcagaaaccgcagggatgggtttggcaaagcaagttcccccacaggttattcaactgaaggccagtgctacaccagtgtcagtcagacagtaccccttgagtaaagaagctcgagaaggaattcggccgcatgttcaaagattaatccaacagggcatcctagttcctgtccaatctccctggaatactcccctgctaccggttagaaagcctgggaccaatgactatcgaccagtacaggacttgagagaggtcaataaatgggtgcaggatatacacccaacagtcccgaacccttataacctcttgtgtgctctcccaccccaacggagctggtacacagtattggacttaaaggatgccttcttctgcctgagactacatcccactagccaaccactttttgccttcgaatggagagatccaggtgcgggaagaaccgggcagctcacttggacccgactgccccaagggttcaaaaactccccgaccatctttgacgaagccctacacagagacctggccaacttcaggatccaacacccccaggtgaccctcctccagtacgtggatgacctgcttctagcgggagacaccaaacaggactgcttaaaaggtacaaaggcactactactagaattgtctgacctaggctaccgagcctcagctaaaaaggcccagatttgcaggagagaagtaacatacctggggtacagtctgcaggacgggcagcgatggctgacggaggcacggaagagaactgtagcccagataccgaccccaaccacagccaagcaagtgagagagtttttggggacagctgggttttgcgaccttagcagccccactctacccactaaccaaagaaaaaggggagttctcctgggctcctgagcaccagaaggcatttgatgctatcaaaaaggccctgctgagcgcacctgctctggccctccctgacgtaactaaaccctttaccctttatgtggatgagcgtaagggaatagcccggggagttttaacccaaaccctaggaccatggaggagacctgttgcctacctgtcaaagaagctcgatcctgtagccagtggttggcccgtatgcctgaaggctatcgcagctgtggccatactggtcaaggacgctgacaaattgactttgggacagaatataactgtaatagccccccatgcgttggagaacatcgttcggcagcccccagaccgatggatgaccaacgcccgcatgacccactatcaaagcctgcttctcacagagagggtcacgttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaggatggctggggcggcggtggtggatgggacccgcacgatctgggccagcagcctgccagaagggacttcagcacaaaaggctgagctcatggccctcacgcaagctttgcggctggccgaagggaaatccataaacatttatacggacagcaggtatgcctttgcgactgcacacatacatggggccatctataagcaaagggggttgcttacctcagcagggagggaaataaagaacaaagaggaaattctaagcctattagaagccttacatttgccaaaaaggctagctattatacactgtcctggacatcagaaagccaaagatcccatatccagagggaaccagatggctgaccgggttgccaagcaggcagcccagggtgttaaccttctgcctataatagaaacacccaaagccccagaacccggacgacagtacaccctagaagactggcaagagataaaaaagatagaccagttctctgaaactccggaggggacctgctatacctcagatgggaaggaaatcctgccccacaaagaagggttagaatatgtccaacagatacatcatctaacccacctaggaaataaacacctgcagcagttggtcagaacatccccttatcatgttctgaggctaccaggagtggctgactcggtggtcaaacattgtgtgccctgccagctggttaatgctaatccttccagaatacctccgggaaagagactaaggggaagccacccaggcgctcactgggaagtggacttcactgaggtaaagccagctaaatacggaaacaaatatctattggtttttatagacaccttttcaggatgggtagaggcttatcctactaagaaagagacttcaaccgtggtggctaagaaaatattggaggaaatttttccaagatttggaatacctaaggtaacagggtcagacaatggtccagcttttgttgcccaggtaagtcagggactggccaagatattggggattgattggaaactgcattgtgcatacagaccccaaagctcaggacaggtagagaggatgaatagaacc

SEQ ID NO: 61 - DNA, 7941 bp, Artificial
  ss462 sequence
tgtcagtttgaaataagagttttaactaaggaacaacccccacccccttggctaaaaaggcagctgcaggcctttccagctatgctcacctcatatcacccttcttgtaataatgtagcaaccgtgagtgctatgtccaagccagcagccctgctaatcatgtacccagcagtgcttatcagttccacttctgtaaccttacttgctcagtttcttagggaggaacactgtctgcttggggaaggggggaggtctgggatacttacatgggaaaatcaagaccttgtaatgtatgaaagttgctgagaacaaagacctggtgctcagattctggaggtgactcctctgagcccgcactggtgctgagtaaactttgcttttccatatctctgagtgtcatttttctgcttcagctgccatggtttttgcagttcccacaacattttggtgcattggccaggaagccgacaactgagctggactcttgtgccaacattgtcagagaaccaggggaggccagggtcaccagcctgatgacagagagatagtgcacactggccattttgccagatccagacactcatttgagcagtgctggccttggctcatacctcttccccaatggactcagaaggagagtggaaacaggttccagaacaggacattggattggtaagtacccctgggacatctgcccaagtcaggtcccaccatatggcggaaggagagactgatcacctctcagtgaccaaagagtcattcaggtcaggattttttcccttggaattgggacgcttgtcaattctggtgtttgtgtgtgtgtgtgtgtgtgtgtgtgtgtgtgtagagaatgagagaccatgctccaccatcttcagactatgaaaccagagtgagtcctaaactgcagttctgtggcaaccctcatacggcttatggtggccttcttcagagggatcctgacattggggtttatacagtcccaccaaagcaaagaggtacctgaaatatctcctccatgggaactgtcaggtggacaaagtgactattacctgaggccttgtcctcactgtttgtcttgtgtcaccatcacagggtgggactttacacaatgggtaaattggcttccaagcccactgtcttagagtttatggttaagaattttaagaaagggttttctagagattatggtgttaaactgagtcctggaaaactgtgtaccttctgtaccctagaatggcccacctttggtgttgtatggcctctggaaaggaccttagatgtgtttatgattggagcagtatataatgttataacaggagaccctggacacccataccaatttccatatattgatcaatggttggaaattgcctatttgaggctcctatgggtttggttctgtgccacaggccagggacagtgtaggttgctagtagcccagtccaagaaaaccttgtcttgagaaaaggttccacctatttttcaaggggaaactgaggacttgccctctatgccactaccttatgtgctgccagccccacctctgggagccaaaggtccccagatgacagatagcccaccgccttctgtttttcctcctcttcctgctcctgaagttcccaaggcaatatcacccccacagccaaattcaccagaaccaatgagcagacatctccagtcagcccagggagcagctgctccagcattgaaaatgcccttatgggagacacggggaccaagacaaatcaccctcgatggggccatacaagaggggggatggttttttttattaccagcccttctccactgccaatctcctcaactggaaacaccatactccctcatattctgaaaagcctcaggctctgattgatctcttagaattcaatttccagacacactgccccacctggatagactgccagcaactactttttactctgtttgacactgaagagtgctggtgaattgtgacagaagcccaaaaatggcttcacgccaatgcagggggtcaagaagacttggcaaactggggaagggaagacttcccagaagaaaacccccactgggactatgacactgaagaagggaaacataacctagagaggtactagcaggccttcctacagtgggcaaaagctggggctaaaaggcatcctaatatagctaagaccagtgagatactacaagagctgaatgaaagcccagccaaattctatgagaaactatgtgaggcttttcaaatctacaccccttttgatcccaaggcacctgaaaaccaatggatgataaatgctgcctttgtgggacaagcccaatcagatatccgtaaaaagctacagaaattagaaggatttgcagcaaagaatgctaccaattgttggaaagagccaacaaggtttttattaaccaagatcaggtggcccaccatgatgaagaaaagagaatgaaacaaaaagtgacacttctggtggtcaccctgtcaaaacctgtgcccccagtgggaccaccataggggacaaggcccaaggccagggaaaagtagtcccctggaacataatcaatgtgcttactgcaaagaaaagggacattggaaaaatgagaaaaggaccaaccatcctgagaaaaggaccaaggccccacctagccggtactgatctgagctattcagcaccaacctgatcgacctagccgagtctgactggggggaccaggctgtctccaactgggcccccaagagtctatggtcagaattcaagtagggggccatcccatagaatttatggtagacacagctgccgaactttctgtggtcatgcaacctgtatcttccctcttggggaaagaaaccaccatcactggggctacaggtgcctaagcccacagtcccttctgtggtccccagcaataccgatgaggaggccatgaagtaatacatgaatttctttacctgcctgactgcccagtccccttgaaaagaagacacctgctggctaaaatgggggcaccaatttcctttttccactgatggatcaggccaattcaaattaacagaatccccctgtcctttaatcatggctcttgctgtaagaagggaagaggaatggtgcttgaactcttccccttcagaaatggggaccattcccccagaactaaggactaaatacccattggtttgggctgaaggaaacccatcaggactggcaaaataccatgctcctaccttgattgatctaaaacccgaagctcaactggtaaagctacagcaatactcaattcccagagaagcttgcctgggaatccaagttcacctggatgggctggactgttaataaaatgtcagtcgccctggaacacccctttactgtccataagaaaactgggaacacaagacttgagagccataaatgaagcaacagtcacattacacacatccatccctaacccatataccctgctagggctgatcccctccattgctgattggtttacttgcctggacttaaaagattcctttttctgcctctgggtggcacctgccagtcagctgttgtttgcctttgaatgagaaaatccacatacaaaggaacagctcacaaggattcaaaaattctctctctctcccactctttttagcagcaccctagccgctgacctggctgaatttcctggacaaaaactgggctgtgttttgctacagtacattgatgacttcttactagctagcaccacacaggctcaatgcctagagggaacaagagctctcctttccctaataatggaggcagggtatcaggtatcaaacaaaaaggcacaaatctgtaagaagcaagtcaagtatctgggctttaacatcatgcagggccaatgaatgctgggaactgaaagaaagcaggcagtttgtgccattcctctccctaccacccacaggaaacttcgtgagttcctaggggcagcagaattctgtcggatatggatccccaggttttcagacttggccaggcctctgtatgaggctctaaaagggaaagaaaagactccccttgaatggggaccaagccaggaggcagcatttctgacaatcaaaaccaaactcaatgaggatccagccttgggacttcctgatgtaaccagagaatttaacctttttgttcatgagaaaaatgggatggcattgggaggcctaacccaagaatttgggccttggcagaggccagggacatagctgtctaaacaaattgactcagttgctgctggatggcctccctgcctcagagcgctggcagctaccaccttgttagggagagaggctgacaagttgtctctgggacaaaacctcaactttaaagtcctgcactcagttgtaaccctaatggacactaggggccaccactggctcacgcatgcactaatgactcaatatcaagggttactatgtgaaaatccatgggtaaaactggaggttgtacgaactctgaacccagccacttttctgccatatgaagcagggcccccagaccgtaactgcttagaggtactagatgaggtgttttcaggtctgacttgactgataaaccactccaaaatcctgacctggttttatatactgatggcagcagctttatgggggatgggaaaaggatggcacaatatgctgtggtatctgacttagaagtgatagaggtgcttccttgaggctggtcaacacagagagcagaattatcagccttaataagagcactggcgctcagctgagaccatactcacggtgtgcctttgcaaatttatatgtccatggagccttatataaagaaaggaaaagggattaaaaaccaggctgaaatcttaaagctcatagaggcagtatgggagcctaaagaagttgcagttatccactgtaaaggccaccaaaagggagatgacccagcgacaaaaggaaacaaaccatagtgctgatgcagctgccagacaggcagcccagggacaacagccagacaaacctaaggtcttgctggccccagaagtgccagctgtccccaaattattctccagaggaagaaaaatggataggggaggaaggaggaaccaaaactaagatgggatgttgggtcacatgggactaccgggtttatgttccagaacagctagcctacaaactagtccaccaacaacatgagctaccccacatgggcaaaactgccttagagaccttactgggcgggtactatctcattacacatcttctcgcactctgctcctctgtctcccaaagatgcataagctttttgcagaataatgctcgccaggggcccagcagaccagctgggacacaacactgtggactgtccccttttgaggatatggaagtggactttactgaagtcacccctagtaaggggtacaaatacttaccagtttttatctgtgctttttcaagatgggtagacgccttccctacctgaactgaaaaggcaagggaagtagccaaggcactcctaagagacattattcccagatatggaatgcctctgaccattgggtcagataatggaccagcatttgcggccggtggcaaaagccttacagatctgatggaaattacattctgcttattgcactcaaagttcagggaaagtagaacgcatgaactggacccttaaacagacactggaaaaggtatgtcaggaaactggcttgccctgggtagacatgttgccagtggccctcctaaaatgagacgctcaccccgagtgggaatagggttctcaccatctgaaatcttatatgggaggccacctccgctgatcaatttaaaaggaaacaccagagagttgggagacttgaaattacataaacaattacagggactggggctatctctcagatatatagaagggtcacagatagaatacctgtgtccttagacataacagttcacccccacaagctgggggacaaggtgtggataaaggactggaaaaaggaggctttgaggctggtatggaagggccccaggttgtaattctaaccacccccactgttcttaaagtaacagagttagatgcttggttccatcattccagaatcaaactggctggtccggctgacaaccgtggagagtggtagactacccttgatacagagagacctctatgcctgaccatacagaggaggagacaacgatctcaaagccctgctctgaccacactggaagctggtccgtcaatgcacagctgaagcttgaggaattgtctgcccagtaaaataaactaccttatcttccacaagagactttcttactgttatatactgttatcttatatccaacatgtatgtttgctgcctgttgctgttaatctggtcccctttggcactgccaggatccatttcctcatgtgacccatgcattcgagtgacctgatcagatcaaggggttacatggacttggtttactcaactcatttcccctgtttgggagaaattcaaggaaactgtactcacaacaggaccacttattctatctgtcaacagggggaccaatatacttgctttgatccacgatactcaccaactgaggaatggttagaggtccagcactctcataaatcagggcaactaattaattggacccaaattaccaaccctgagttgccagtataaatactttttgatgcctatgaagctatgaatgggtcatggacttctactagaccatgtggaagcccatcttgggaaagagaatataggctccaggataaatatatgtgctgtaggaccacctggagtggttgccaggtatgcacttactggagctgcatagcctgggcaacctgggataagggagacagaacagctgtccttcaaaagggtacagcccctccagactgtcagactaaaacttgtaacccagttaaattcactattttcaattccagtgagcccaaatggaaggaggggttcaaaataagcatttgcattaatgaaagaggacttggccctggagctgtgccacatttccagagaataatgcttgcactccaagctgcctctcacagggtctttcattccatttatgaaaagatgaaaaaaacagcacacctcagctaagaacttgttctttgccctagcagaaactattgcacaaactctcaaggtcttctatttttatgtatgtgggggaatgaacacaggagaccactggccttggcaatccatggaactgaacccattagagcctcataatgaaactgcatacccccaactcaccagtggggtatggctcctcagaactgctattatagggagaaactctggtgaagtggggaggatggttcagtgtttctgttggaagcctaacatgtttaggcctaaggttttataagaaccatagttgaaagaaaaacagcctcccacctgctacttatcagaggttaccaatgggtaatgactgatgatctctgaagtgtgcagatgcaccctgaacatcaagaggggacaatgaaataagagttttaactaaggaacaacccccacccccttggctaaaaaggcagctgcaggcctttccagctatgctcacctcatatcacccttcttgtaataatgtagcaaccgtgagtgctatgtccaagccagcagccctgctaatcatgtacccagcagtgcttatcagttccacttctgtaaccttacttgctcagtttcttagggaggaacactgtctgcttggggaaggggggaggtctgggatacttacatgggaaaatcaagaccttgtaatgtatgaaagttgctgagaacaaagacctggtgctcagattctggaggtgactcctctgagcccacaccagtgctgaataaagcttgcttttccatatctctgggtgccatttttctgcttcagctgccatggtttttgcagtttccacaacaaattca

SEQ ID NO: 62 - DNA, 10115 bp, Artificial
  ss470 sequence
tggttaatgaatccgactgggaaacacgagatttcgggttcgatccctagcctcgctcagtgggttaaggatctggcgctgccgtgagctgtggtgtaggtcgcagccgcggctcgcaccccgtgttgctgtggctctagcgtaggcctgtggttacagctcagattggacccttaccctgggaacctccatatgcctcagaagtggccctagaaaaggcaaaatgactaaataaataaataaaatattttctccctatgttttctttgtcagatccaggtattgacaatatttcatgccaatctgtgtgaactctttattatgggatcattgatatacacgaatctttaaatttaatgaggtttaactttttacctttcctttatattccatccatttttgtttatttaagaatgccccaggtcataaacataccctcctatattgtctgctaagaagacaggagttttggagttcccttgtggcacagtgggttaaggacctggtactgttactgcagcagcttcgctgctatggcacaggttcaaccctggccagggagcttccacacgtggaggacaccacaaaattaaaaggcaggggttttgtttttcatatttgggtcttcaatctgtatggagttttgtgtatggcataaggtaaagattcaatgttctcagtatcacttagtgaatatctaactttccccttcacatgggatgaaactaatagtagattccttctacttggctgcactaagctatttgttgcacaaacacaccaccactctatattcactggacaagtcactccaccttgctctttttcttcaaaattgttttggctatttctggctctctattcttccaaaaacattttacagtctcttgtcaaatcatcacacttgtacacactagagttgacagaattttgtttagaattgcactatctacttatctatctatctaattttagcatcaacagtctaaagtctttttcctggaggctgagaatctcctgatcacttacctgattttctgggaatttttctttctccctcatctgagttatagttctctgtcttttcatttttataggtttttggtgtggtgacttttttacagataatagagttgtagcctctcttacttctggtgtctgccccccctgcggctgaagttagtatgcagttggggagttggggggggtggagtgtggggggggtggcttgctgtaggcttcctgatgggagggactgatgcttgtccctggtagctggagctgattcctatccctctggtgggtggggctttgtctctggatgggattagaggcagcagtgtgcctggagggtctttaggcagcctgtttactgaggggcggggctgtgatcccacctgggttgttgtttgcccttgggcttctcagcactgaggggtggggcagatttccccaaaatggccacctccagagaaaggcatgctgctgaatactcccaagggcttagcttccaatgcccttccctgcaacaagccattcagccgttttcccagaaggttctccaagaactgcagtcaggttcgacccagattcctatggagactttgctttgccctgggacccagtgcaggtgaaagtctgtgtgcatcttttgagaatggggtctccattcccccagtcctgtggagctcctgcacacaagccccactggccttcagtgccagatactccagggactctttctcccagtgccagatccctacacatggcagtttgatgtggggctcagaactctcactcctgtagctgagtctctgtaaaccagttagtttccagtctgtggggcttcccacctgggaggtatggggttatttataccgtgtaatcgcccctcttacctcttgatgtggcctcctctttgtcttctggagtaggatatctttcttaaggtttcaggtccattgctcagcctttagttgtgaattttgttgtttctgggagagaagttgagctgcagtccttctattctgccatcttaatcccatcctcctatctatctatttaattttatggccacacccacagcacaaggagggcctgactcgatgccagataggtccccagatgccagatagcccaccgccttctgtttctcctccttctgcttctgaagttcccgaggcgatatcacccccacagcagattctccagaacctatgagcaggagtctccgttcagctcagggagcagccactccagcattacaaatgcccttatgggagacacagttgcccctgatgggaccatacaagaggggggacgtttttattattaccagcccttttccactgccgatctcctcaactggaaacaccatactccctcatattctgaaaagcctcaggcactgattgatctcttaaaattcattttccagacacactgtcccacctgggtagactgccggcaactcctttttactctatttgacactgaagagcgctggcgaattgcaacagaaacccaaaaatggcttcaggccaatgcagggggtcgagcagacttggcaaactgggtgagggaagccttcccagaagaaaacccccactgggactatgacactgaagaagggaaacgtaacctagagaggtaccggcaggccttcgtacagggggcaaaagctggggctaaaaagcccactaatatagctaagatcagtgagatactacaagagccgaatgaaagctcagccaaattctatgagagactatgtgagcctttccgaacctacaccccttttgatcccgaggcccctgagaaccaacggatgataaatgctgcctttgggggacaagcccaatcagatatctgtaaaaagctacagaaattagaaggttttgcaggagagaatgccactaaactgttggaaatagccaacaaggtttttattaaccgagaccaggtggcccgccgtgatgcagaaaagagaatgaaacaaaaagtgactcttctggcagctgccctgtcaaaaccagtgcccctagtgggaccaccccgtaggggacaaggcacaagaccagggaaaaggagtcccctggaacatgaccaatgcccttactgcaaagaaaagggacattggaaaaatgaatgccccaaccatcctgagaaaaaaaccaaggccccacctagccggaaccgatatgagccattcagcaccaacctgatcggcctagctgagtctgattaggggagaccaggctctctccaactgggcccctgagagcctatggtcagaattcaagtagggggccaccccatagactttatggttgacacaggtgccgaactttctgtggttacacaacctgtggctcccctctcagggaaagaaaccccattgttggggccacaggtaaccaaacccacaggcccttctgcggtcctcgacaatgtcggttaggaggccatgaagtaatacatgaatttctttacctgactgactgcccagtccccctgatgggaagagacctgctggctaaaatgggggcacaaatttccttttctactgatggatcggcccaccttaattgacagaacccccttctcctttaatcatggctcttgctgtaaaaagagaagaggaatggcgcttgtactcttccccttcagaaatggggaccattccccagaactagagactaaatacccattggtttgggctgaaagaaacccaccaggactggcaaaacgccacgctcctgtcttgattgatctaaaagccggagctcaaccggtaaagctaaggcaatactcaattcccagagaagctcgactgggaatccaggttcacctggataggctgcttcagcatggactgttaataaaatgtcagtccccttggaacacccctttactgcccgtgaaaaaaccgggaacacaggactaccgcccagtacaggacttgagagccataaatgaaacaacagtcacattacacccgtccatccctaaccccatccctaacccgtataccctgctagggctgatcccctccactgctgagtggtttacttgcctggacttaaaagacacctttttctgcctctgggtggcacctgccagtcagcccttgtttgcttttaaatgggagaatccacatacagggacaaaggaacagctcacctggactagactcccacaaggattcaaaaactctcccactctttttagcggcgacttagctgctgacctggctgaatttcctggacaaaaactgggctgtgttttgctacagtatgttgacgacctcttactggctggcaccatggaggctcagtgcctagaaggaacaagagctctcctttccctactgatggaggcagggtatcgggtatcaaagaaaaagacacaaatctgcaaaaaacaagtcaagtatctgggcttcaacatcatgcagggctgatgaatgctggggactgaaagaaagcaggcagtttgtgccattcctgtccctaccacccaccggaaggtttgtgagttcctaggggcagcaggattctgccggatatggatccctgggttttcagacctggccaggcctctgtatgaggctctaaaaggggaagaaaaagctccccttaaatggggaccaaaccaggagacagcgtttcagacaatcaaaaccaaactcactgaggctccagccttgggacttcctgatgtaaccagagaatttaacctttttgttcatgagaaaaatgggatggttttgggagtcttaagaatttgggccttggcagaggccagtggcatatctgtctaaacaaattgactcagttgctgccagatggcctccctgtctctgagcgctggcagctaccaccttgttggtgagagaggctgacaagttgaccctgggacaaaacctcaatgttaaagtcccacactcagttgtaaccctaatggataccaggggccaccattggctcacacatgcacgaatgactcaattcaagggttactatgtgaaaatccacaggtaaaactggaggttgtacgaactctgaacccagccacctttctgccagatgaagaggggcccccagaccataactgcctggaggatgggtagaggccttccctacccgaactgaaaagacaagggaagtaaccaaggcactcctgagagacattattcccagatatggaatgcctctgaccattgggtcagataatggaccagcatttgtggccgaaacagtacaacaggtggcaaaagctttacagatccgatggaaactacactctgcttatcgccctcaaagttcagggaaagtagaacacatgaaccggacccttaaacagacactggcaaagttatgtcaggaaactggcttgccctgggtagacatgttgctggtggccctactaaaagtgagatgttaaaccctgaacaggaatagtattctcgccatttaaaatattatatgggaggccacctccactaatcagtttaaaagaaaacaccagggagttgggagactgggaattacacaaacaattataaggactgggactcactatttctcagatacataaatgggtcacagaatacctgtgttcttaggtataacagtacacccccacaagccgggggaccagatttggataaaggactggaaaaaggagactttgaggcccgtatggaagggcccctgcactgtaattctaaccacccccactctattcttaaagtaacaggaatagatgcttggatccatcattctagaattaaaccggctggcccagctgacgcccgtggagagtgggagactgccctcgatccggagagacctcttcgcctgacaacacagagaaggagacgatgatctcaaagccctgctctgaccacaccggaagctggtcagtcaacgcacggctgaagcttgaggaatcagcagcctgtgagcccaaatggaaggagggtttcaaaataagcattcacattgatggaagagggcttgaccctgcagctgtgctacatttccagagaatcacgtttgcgctccaagctgcctctcacagtgtctttcattccttttatgaagagataaaaaacaccccacctcccattccggccacaactaagaacttgttcttagccctggcagaaactattgcacaaactctcaaggtctcctcttgttatgcaagcgggggaacgaacacaggagaccactggccttggcaagccagagaactggacccattagagcctcataatgagactgcatacccccaactcaccaatggggtatgactcctcagaactgctattatagggagaaattgtcttgcgaggcggggaggacggtttaatgtttcagttggaagcctaacatgtttaggcctaaggtattataatctgactgcccaaaagactcaatggtggtcagcctccaatcgctcagagcccaagcttaatcccttgtctaacttttccctccttcgacaaacatgggaagatatcagtactaatatccagtggcgggcaccaaagggattatattggatttgtggaaaaatggcctattccatactcccccccaaattggactgggacatgtgtactgggaacaatcagaccttccttcttcctgctcccgctgtcactaggggagcaactgggagttcctatacatagggcacagggtgcccagagagaccggagggctctccaaattggagaccggaaagatgataaatggcccccagaatggataattcaatattatggacctgccacctgggcagaggatggctcttggggatatcgcacccctatctatatgctgaaccgtatcatcagactacaggcggttttggaacttataacaaatgacactgcaagggccttgactatattggcccaacaacaaactaaaatgcgcagtgcaatctaccaaaatcgcttggccttggattatttacttgcttctaaaggaggggtttgtggaaaatttaacttaagtaattgctgtctacaaagagatgacactgaaaaggtggtagaagaaattgctgatcgcatgactaaactagcccatgtacctgtacaaacttggaaaggatgggatacagacagtgtctttggtaaatggttctcttggttgggagaaattaagacaatggtcggaataattatggttatactcgcagggtgcctacttgttccctgccttgtacctctcctgataaatattataaaaggtttttataaaaaaacatggttgaaagaaaaacagcctcccacctgctacttattagaggctaccaaagggttatgactggtgatgatctgtaaaggggtgcagatgcaccctgaacatcaagaggggggaatgaaatggagttttaactaaagaacaaccccccacccccaccccttggctaagaaggcagctgcaagcctttccagctgtgctaatccctatgccacccttcttgtaataatgtaacaactgtgtgctctctgtccaagccagcagccctgctaatcaggtacccagtattgcttatcagttctgctctgtaaccttgcttgctcagtttcttagggaggaacactgcttggggattggggaggtccgggatgcttacctgggaaaatcaagaccttgtagtgtataaaagttactgagaacaaagacctggcgctcagactctggaggtgactcctctgagcccgcaccggtgctgaataaaccttgcttttccatatctccgagtgctgtttgtctccttccgttgccacagtttttgcggtttccgcaacaatctctccgctggttaaccatggtggcagccttcgttctggcctttctgcctcagcatctccttctctacagcctattcacacagcagtcagcttgatttttaaagacacgaatcaggtcgtggcccttgtattacctaaaatcgccttgtagccccagtggtgccaaattccacactttgggaaacaatggtttaaatgagtgagtgagtgagtggatgctgactaggaacagagaaatggtcaagtaagaagtcatccctagggaaaaccaaaatggaaaacacggcactggcctcagcagagacctataccacggtgaggatgaacttgaggttcacgatggagccagaggctaaagcacgggcactggccatcgcgcctgaaccgggaggataccgcgcgcagggcgcagcgaccgggagggcgagtccagggccgcctgcgcgcgtccgcagcccggcccagcccgaccgcgtggctccgcacggggacgcgctccgagggcgcgctccgggcggcggcggcgcgcggggcagccgtggcgggagaaacgcttccggtggcggaggaggcggccccgagcaggtcctgcaagcggcgcgagtggtggcccgccgggagcggtgagtcgcgagcgatcggcccgaatgcagtgagtgggagacgcccgggagcctggcagagggacacgagctggagcgggggccgcccttgccgagttgttgcagggagacccccgggctgagaggtcagaagcccccaaaccatagccgggactcccccggccaggggcgtccctgcactttggggacccctgccatcccgctgcctgaactccccacctccagcagcctgacctactccgagatcaccctgagccccgcagtggagtgggtcacccctgatgggaggaggcccacccatccactcccgcaagcgccctgccacgctgtccccacggccgcgtgacgaaactcgccgcggggggacacccaagatggctgccgcggggacaggccacgatggggacgggcgccagcgattgagaagtggcccagttgcaccgaacccctgcccctcaagttcctagcttcctggcttctcttccttgcgcagagcggggctccagggtcagagaccacctggcccctgccccagaacttgcaatatggtaggaaagaaagaggctggtaattggaatagtggtccttctgggaccttgcattttgtgctgacctcctaagctttcccacatgttacaggtcgctaaccttctcagaatgacagtagccgcagtgtctacttagtgtgggctggtaattcgggtctacctactttacactcatccagccccaggaggtacttggctttgccttcctaatacagataaggaagctggggctcagagaggttgagtaacctgccttaaatcacacagttggtcacctataatctcagcttaaatattacttcctcaaatatgctctcgcttggctgcttgtttgaaattgctccctcatgcacacattctttattagattactcctgtgttttttctttaagagcatttgtcaccagttgaaattaactgttgacttgcttctttgattctctgtttgtgatcatggcctctgttttgcttctctcactgttccctgcatcaggtagaccctcactgagtgcctgaatgaaaaagcttagcacaagtgacttcaaagctagggcacttaaccactccatgggccttctgaattccccatggcattttctggatacttttctcaaagtcgtaatctctattctccctcctcttccagatcttgacttgggtgcctctagctttgcttgtcctttgcccatccccagtctactgagctgcttccatgttccaggcattgtaaaaggtgcaaggtgggtagacaggtagataaggaggctttgcagctcttaaggtgctgatcttgccatatacaagctgtaagatgagagggaaacctgggaggatgagtggaagctccaccatcaggttctgggacctcaagcaggttctttctcccctcaggaccacaggtatctggcttgtaaaaaatgatggtgtttgggagttccagtcgtggctcagtggttaacgaatccgaccaggaaccacgaggttgcgggttcaatccctggtctcgctcagtgggttaaggatctggatggccatgcgctgtggtataggtccagacacagctcggatctggcattgctgtggctgtggtgtaggccggtggctaca

SEQ ID NO: 63 - DNA, 4264 bp, Artificial
  ss297 sequence
atggggaatacttcctccagtcctccgggaacatgcctcttggctggctcttgtgaaattcagaacgctcagactaagaggagacattaggtccaagcatcttaaatttataataccacttggacacaatatagattggataacaggtctcaatgacccccaaaaatggcacttttgatttaaatatcttgcacgaccttgataacttttgtcaccataatggcaagtggtctgaagttccctatgttcaggcttttgttaccctccgttcccgacccttcctctgttcgtcttgctccacctttcaattttttctcctttcttctaaagattcacaactgcctccctctgattctgatacctcctcttttgatcctgcagagcatcaccttctccctgtataaccccatctgggccaccggctctcccaccaactcacagtcatcctctcctccacccctggcttcctcagctcctgctgatcctaattcagattgcattccctctttctcccttcctcatacaaggtcccagacttgacctcctgtctccaaagacacccccaactggcttctttactccctttatgtgaatttgcagaactgaagggtttgtccaggtccaagccccttactctatgtccaacctttctcaaattaaaagaagattaggctctttctcttctgacccctccacctacattaaggaatctgaatatctcattcagtcctgtgaccttacctggcatggcatctatatcatcttatcctctatcctcccacccaagaaaaaggaaaggatctggttagctgctaaggcccctactgatggccctcactggcaagataaccaccatgcagttggagcagtagcagtccccagacaagatctagcctgggaccaagtagattccccagctgtgaactatgaaaaactaaaggaaattagtcaaggctcacataaaaaccctgccctctttctcacttaatggaggctctccaaaaatataaaaatttagacccttccccagtagaaggaagttttttctcaaacactcacttcatctctcagtctgtacctgacatacggtggaaactacaaaaattggagaatggtcattaaaccctgcaacaggatctcttgaatctcaccttcaaggtctttaataatcaggatgaagaggctgaaagccacaaattaaaaagagatcaggctaaataccaaatgctggcaactaccattcagggctcccaaagataaaggctcccttgaaatgacaatggctctgaggctcctccaggcccatgttacagatatggcaaggaaggccattgggcaaaggcctgccctaacccttgctctcccccaggccttgtccacaatgtggcaagagaggccactggaaggtcgactgtgaccagccccctcagggagggccacatcccttcacgcagagagactagaatcattgaacctcaacctgctgagcctcctcggcctggccgcagaagactgaagatgcctgggtttcccagcccccacacctatcactccattggagccctggataactctgctggttgcaggtaagccgatctcttttcttattgacacggaggccacttatttggcactgccttaatttgcaggccaaatgcacccctctcaagtctccataatgggggttgatggcctaatctccaaactcttaacagcacctcctctaaattgcaccctatcaggaactcccttcctgatactacccaggtgtccaaccccgattctcagcagagatattctacctaaattcagagcctcccttatgcttctcactcctgtctccattgccaacccttcccaattcctccttcttactcatccagaacctgataaactacctctcccagcctccatgtttcacccaagatatgtgatacctccaccccttccatagctcaatatcatgctcccattcaaattaagctaaaagatccatccacttaaccctgccaacctcatatcctttgtcccttgagagcaaaaggggcctctaacctattattaactatcttctttctcataacttactctgacccactcactccccattcaacactccagtttctactggtaaaataagccagatggctcttactgcctcgtccaagatctccgcattataaaccaggcagtccttcaaactcacacggggattcctaacccctataacatcctatcctttattcccccagatacctcccatttcactatactggaacttaaggatgccttctttactatccgtttacacacagactctcagaacctttttgccttcactcagacagatcccaacacccatcaatggcatcaacttacctgggtggtccttcctcagggtttttgggacagcccccattttttcagataggccctagcttcagatatcaccactctcgatctcacccccagcagcttcctccaacatgtggatgatctcttactctgtagcgcatcttatgacacttctcttaaacatatggcaaaacttttaaaccacctggccaataaaggatatctggtctctcccaccaaacttcaacccctctaccctaggtcaaatacctcagactctattaccctaggacatcacactatcactttctctcctctcacttccaaacaggaactcctatctttccttggccttgcaggattcctctgtatgtggatccccaacttagggcttttggctcatcctttataccaagctaccaaagggcctctaacagagcactggaccccactgtcagtattaaagatcccttccaaaaaaaaaaaaaaaatgacctgaaaaaaaaaaaaagatatatgttagaatactttaagtacattaccatatttgatcttcctaaaacctataaagtagataatgttcacattatatggtcagatgttgaaactcaaaaaatttaaattatttgccaaaaatgatacgtctagtaagtagagatggctgctaaatctgggctcaaaacaaactggaagcatggcataaagagggcctagaaaagaagcacagtatacaacacttatgaggaactgaacctccttggagtccttttagaaagttcaatcacttcctttgcagaagcagatgggtagcacagttatctgtgtctttgctcgttttactaataccattcccttctcacaacaggataattttttgttcatttaaaggtcatgtttttaaagctattgacctagagttgtcatcacattcttcctacttcaaatagtctgagtagtaaaataaatatatctttacctttttactgctaaccagattgactcttcaaacaaagggaaagagctaacttatgaaaaataatacatgatacatcatgatatacttgcccccatgatggagactctctccttaaaatacacatggattggagtatcttcatttcagaataaaagtagtccatatgagagggtgggggtctaaaaacagaaaaacaaaacaaaacaaaaccaagagtaaggaacattgaatataatgggcaagtggaaaaggcataaggcagctgagttcaggagagaaaaaagggtaaagagaagtagaatatccccctttggacattttccccaagacatgctaaaagaaaaggagcccagcagagagggcttctctaaatatagagccattcatccaaccaaagttggtctttctattttatgtttctcatgatcaaatttcatgctacagggctcacacttctaggctgtgtggtcaactgttcattgagcactcagggagccagccactgaagatacagtgtggcacttcatgcaaaagtgcaaaggatcatagagaaggatcatagagaaatatggggcatgaataggccatgagggccatgcaggcatggggattcgcctggggccccaaccactttggagaactcatcaacagtaccagtaaaggcagatgcagaatggtccaggcagtgattgatatctttgaaaagattgaggcagtgaggcattctgagaaggtgcataggtttgtgttcattaagcagggtttgcaaagtctctctgagggtcatctcctttctaaccacccaggaaaagaaagaacatagatgagcatacctgggagatcttcatgagatagtcctccaaggtacacatcacttctgctcatattccactgactacaattcacccatgtggccacatttaattgcaagga

SEQ ID NO: 64 - DNA, 8186 bp, Artificial
  ss331 sequence
tgaaaactccatcttgtccttccttactttatcccatcttccttcttggaaaaacagtcacagtgctggtaaatgacttaagcttaagagcaaagacctaaaggcataaatgacttaagcttaagtactgttatgtgcctagaggtcagagtaagagcttaaccctttaccacctaagtggctttctaaatagtaaaagaacttatatcatccacccatagccactcctcacttaatctcacaataaaagcagtgtggtttcttgaggcagtgctcttggtcccggagatctggagttccccggcgctcttggtccctgagaccttgagtcccgcactcttggtccctgagaccttgagtcccccggctcccacctttacttaagataaatgtctctgtgtcttgttttatgttaactatttttccttaagttccacagcacccgttcttccccatcctgctgagctggccccggcaagtggcgcccaatgtggggcaggctcacaaacaggcaggcacaaggaacgaaggaccgcgactacagcagaaattttattctctggaagtgctgtggagccctgagaagaagggaggaattttgtgtggccaagctaaagaaatcctgcagataagttccctctctcaggtatttacggggtaaaatgggaaactataatccttacatttgtttgtttgggtgattggctttttacatcagaaacattatatttaaagatatgggaaatgataggaatggaacttaggatattgcaggatgagggcattcgaattcctgagtccatttggagtacttggaacttaattaaatcagttttagaacttccagagaccacagaggacttagaggaagaaggggagtttacacctttgttggaagaatctaaatatgcagtccctgaacaaaattatcatagagaatctctggctcctgagccttcagctccaattgttgattctgatattcctcaatcgcctcctattaggagtaaggtgacgaggactcgtcaagcctctacttccagggttgtaaagaaagtgagcgctatccctgaacaccacctatcatccattcaacagggaattttacaggctcaaagggaaggtgatttggacgccatacacttagcctttccagtaaccgtcagggagacagtggctccaggcattgatcccgccaaccctgatggagtttatgagttcattcatgagccctttccttttaaaattcttaaagaattaaaacaggccgttcaaaactatggtgttaattctccctttacaaaaggaatcgtgcagggagtagctgaaggaaatcgtatgattcctgctgattggcatagtttaacccgtgctgtgctatcacctagtgaatatttacaatttaagtcttggtggcaagatcatgcccaaattactgctaatcgtaatcaggttcgaaatcttccaattacaatggaacaattgttagggattggtccttggagtaatcttcaagatcaattaagaatgaatgatttggctatcgaacagattagacaatgttgcttaacggcatgggataaaattgaatctacgggtcaaataaatatttcttttcaaaagatcctacaaggccctaaggaaccttatactgaatttctagctcgtttacaagaggcattaaaacgacaagttactaactctgaggtgtctgatactatttttcaattgttagcatatgaaaacgcaaacactgattgcaaaaaggccataggatttttaaaaggaaaagctaacatagccgaatatattaaagcctgtcagggagtggggacggagtcctttaaggcctcaatgctagcccaagcaatggctaatttaaaagttaaagacaaattttcagaaaaatgttttaattgtggtaagacaggacatattaaaaaacaatgtcgcgctcttccacgagcccgacctttctctcatggagcttcagcaccttctagcaacaataataaacagcccagactatgtccaagatgtaataaaggaaatcactgggctaaccagtgccggtccatctttcataaagatggaacccccttgttgggaaactaccctcggggcaagcttccagccccgtcaaccaaggaagcattccccattcggaacaagagccagactccctggaactacgctctgcaccagagttcgacatcacagtagatctatttaattctccttcctagcgaaactcctacttctattacaaccaagttggaaaatccattaccatcagatacaataggattgataataggaagggcagagctaacagaacaaggaattcgagttcataccaggatattggataataacggggatgataaagtacaagtgatggtttccactgcgattccttggaaaattaaaaaaggggatcagattgctcaaatcttaattttacctagagtccagaagaaaaaagacaggaataattttagacagaagagattcaataccacaggaggggcaggagtgtttttatcagaaaaggtcctagaggaacgacccacttgtcaagttatcataaatggaaagtcttttagaggattgattgatactggtgctgatgtttcaatcattagccatttacattggccagacacctggcctcttcagccagctgatattgaagtcactgggttaggaaaagcagagggtctcaaaaagagtgcccaatggcttaattgtgaaggaccagatgggcagccagctagattgaaaccttatgttgctcaactccctatcaatctatgggggagagatttattacaacagtggcatgcagaaatttacttaccgccagtagatcaatatagtcatcaaagccaaaaaatgttgcagaaacagggttacattcccggattgggattaggaagacatcatcaggggagagtggaacctattgaatctgagattaaaatggacaaatctggtttgggatatcggccttttcattagcggccactgcttgtaaaaataattatgtttctcctgaacctattcgactgaaatggactacagaaaaaccagtttgggttgagcagtggcctctttcttcagaaaaattaaaggttttaagtgatctggtccaagaacaattagagaagggccatatagaagaatcctttagtccctggaattcaccagtgtttgttatatagaaaaaatcaggaaaatggagattgttaacagacttaagaggagtaaatgctgtaattcagcctatgggtgcccttcaaccaggcctcccatctcctagtatgataccagctaactggttgttaattatcttggacctaaaagactgctttttcacaattcctttacacccagaagataaggaaaaatttgctttttcagtcccagtggtaaacaatatagcccctagaaagcgttatcaatggaaggtccttcctcaaggtatgttaaacagccctaccttgtgtcagtattatgtggcttcagttgttgagccagtccgaagacaatttcctaaatgctatattgttcactatatggatgatatactttgtgctgcaccctctcaggagcagctgactgaggttttccaatgtttacaaacctgtctaaaaggagcaggattggttattgctcctgaaaagattcaaatgaaaagtccatatcaatatttgggaactgtggttgaacgtaccactgttcaccctcaaaaggtagaattgagaagagatcaaatttctacattaaatgatttacaaaaattgttaggagacattaattggctccgaccttatttggggattcctacatatgaattgtcaaatcttttctccttgcttagaggagattctaaattaaacagcccccgctctctaactgcagaagcggaagaggaactaaaaaagattgaaagtaaaatacaaaactcccaactaagtcgggtcaatctaaaacaacccattcagttagtaattataccttctcctcattctcccacgggaatattaatgcaattagaaaatattctcgaatggctttttcttcccaataatgtcacgaagtctttgtctccatacctggacttgatggcacaacttattctaaaaggtcgcactcgctgtgtacaaatgtccggaaaagatttgaatcatgtaattgtcagtttaactattaaggaaatccaaaattgttttcaaaaccatataggttggcaaattgcctttgcagattacgtaggatcaatagataatcactatccaaaaaaccctgttttacaatttataaagcgtactcaatggattctgccaaaaaaggtgaaggagtcacccatcattgacgcccctgtgatctttactgatgggactagtaaagggaaggccggatatgtggctaatcaatctaaaattataagaacacctggcctttcagcccaacaggctgaactaactgctgtaatccatgccttgagggactatcctgagcctatcaatattctttctgattcagcatatgtagttcatgctgccaaaatgattgaagctgctaccattaaacaaaatttacctgtcttgttatttgacttgtttacaaaattaccaactgttgtaagggaaagaagatatccattttatattactcatatcagagcacatactaacctacctgggcctctagttgcaggaaataaagaaattgactgcttggtgacacctgtgttacaagaagctcaacattttcatgatttaacacatgtaaatgttcgaggccttaaaaaaagatttggaataacatgggctaaagctaagacaattgttcgtcaatgtcctgcatgtcaaattattaacaatccttctcaatctgagcctggagttaaccctagggggcttgtcccaaatgctctctggcaaatggatgttactcattattcatcttttggaaaattgtcatttattcatgtatgtattgacacttactctaaatttatttgggctactgcgcagtctggtgaatctgctaaacatgttattcgtcatttgtatgcctgttttgcagtcatgggcctgccacaagcaattaaaactgataatggtccagcttatatcagttctcaacttaaaacattcctagatacatggcatattgctcactctactggtctcccttacaacccccaaggacaggctattgtggaacgagccaatttatatgtaaaacaggctcttcaaaaacaaaaagggggagacacagaaatagttcaagtcacaacaaacacttttaaacaaaaccttattcactttaaattttttaaacttggcctctgatgaaaaaacagctgcagagagacatttttatacagaacaaaataagattaactttcctcatgctgaacagcccttgatttggtggcaggatccactaacaaacttctggtctccaggaaaacttattacgtggggtaggggatatgcttgtatttcaccaggtcatggattacaacctgtttggattccatcaaggagaatcaaaccatatcatgagcaagcttgtgaagcatcccttgactccagaccccagaaggaggatgatgagggctcatcttcctcatcttcccacttgaggtcagatcaaacatctaacccaagaagctgaaaatctactaagaaaaggaaagcctctcactccaaataatttggtcctagctctctttactttggtttccatcgcagtgagtattctcacaactggcatagaaatcattttattacttgtatagtacagggattaaaagcctcatgagtaaaacccattaaaaactattgaagatttaatgagagagtccatcagctttcttagcaagactcagaagggcattgagaaaacatacaaaggaacccagaaacaatggagggccaaataattcttaaggataaattcatagctcagtcggtgccagatatatggagaaagctccaaaaaattggcttttggccctgatcaggatctggagcacctcctcagagtatgttataattggggccaggaagaatgaaaggagaacaagaagagagcctgagaaaaggctgaggctctagttatggcactacagggagtcaacctgggagtttccaaggtgagaggactagggcagagacctatgcccggagtctgtttcctctgaggaaaagagggaccctttaaatgggaatgccccaagactcagatcactggaagagggattacccctgaagacgaaggtctctgtggttgacccctcaagcccaggatcaagactgatggaacatttccataatggctcctgtccttatcaccactcagccctgggtgactctaaatgtaggaatacagagccacttttcagtcctcctctccaatcctgggcccctccctcatgaatctgccacatttatatttctggcaagctggttacaaaattctttacacaacctttgagttgtgactgggaatccattttcttttctcaatacctttctgattgtttcagagtccaacttctcttttagaaattcttaaaatatggaaggtaactacatacatgttgttacagttgtcaacattaggtataacatattatcgtacctaggtttaacagaagtcaaatgagacactgaaacatcaattactaaacagaaactaaaggtctttagaatgatgaaacaatatgatcagtgccatcctgagatggtctctataagaaaaacatgtgtttttagaaattataaaggagagtccatggttgctttagaaaagtagaatgagtatgttttcaatatagatgaaatgaggaatggaattgcatcttattaacgcaaaagaaagatagtctgtcttcagctgattgctctccttggaaaataagggacatctaaatgttgtattcctgattgttcacagaatgtgtctaattccctgctagatcatcatcagtagattcatgagctgtcaatccagctccagtttttggagctgccctgtggaaccagctgacctcctcctcctggtgaaaatatttctttgaggtatccaaagcaatgttatcaaagcccacttgaccattccatgagtggagacctaactgctttccctaacgacgccccttttcagcaggaagaagttagagcggtcgtcgccccttttcccacagttagagtctccaactcaaaggggggaattaaggtagatttttaactcaggtagtcagtgtagggatatgggctttgatacattctttgtagctatttattaacatttgtaaattgagggtcgcatagcaagcccaactgctataaaggttgtgggtattgccccatggatccatcacattagagtgaagaaggttgcatccgctgctgacatggacactggggaggctgtacagcacctcaagaatctcttcatggtcaagttccagagactccttttgccatcatcagagtgctaagccctgctctggccacccgtggaagctggtcagtctatgcacagcagaagtccgaggagttccacgtgagacttaaaacttgaactctgagacttaacttggactgtgttctaagcgaataattcaagaagaagtgaaaaaagtttcaagaactatttttgtcttcccgcaaaaacaaaaagggggagatgttgcaagacatgtttccttgaaaactccatcttgtccttccttactttatcccatcttccttcttggaaaaacagtcacagtgctggtaaatgacttaagcttaagagcaaagacctaaaggcataaatgacttaagcttaagtactgttatgtgcctagaggtcagagtaagagcttaaccctttaccacctaagtggctttctaaatagtaaaagaacttatatcatccacccatagccactcctcacttaatctcacaataaaagcagtgtggtttcttgaggcagtgctcttggtcccggagatctggagttccccggcgctcttggtccctgagaccttgagtcccgcactcttggtccctgagaccttgagtcccccggctcccacctttacttaagataaatgtctctgtgtcttgttttatgttaactatttttccttaagttccacagcacccgttcttcccca

SEQ ID NO: 65 - DNA, 8184 bp, Artificial
  ss332 sequence
tgaaaactccatcttgtccttccttactttatcccatcttccttcttggaaaaacagtcacagtgctggtaaatgacttaagcttaagagcaaagacctaaaggcataaatgacttaagcttaagtactgttatgtgcctagaggtcagagtaagagcttaaccctttaccacctaagtggctttctaaatagtaaaagaacttatatcatccacccatagccactcctcacttaatctcacaataaaagcagtgtggtttcttgaggcagtgctcttggtcccggagatctggagttccccggcgctcttggtccctgagaccttgagtcccgcactcttggtccctgagaccttgagtcccccggctcccacctttacttaagataaatgtctctgtgtcttgttttatgttaactatttttccttaagttccacagcacccgttcttccccatcctgctgagctggccccggcaagtggcgcccaatgtggggcaggctcacaaacaggcaggcacaaggaacgaaggaccgcgactacagcagaaattttattctctggaagtgctgtggagccctgagaagaagggaggaattttgtgtggccaagctaaagaaatcctgcagataagttccctctctcaggtatttacggggtaaaatgggaaactataatccttacattgtttgttggggtgattggctttttcatcagaaacattatatttaaagatatgggaaatgatagggaatggaacttaggatatgcaggatgagggcattcgaattcctgagtccatttggagtacttggaacttaattaaatcagttttagaacttccagagaccacagaggacttagaggaagaaggggagtttacacctttgttggaagaatctaaatatgcagtccctgaacaaaattatcatagagaatctctggctcctgagccttcagctccaattgttgattctgatattcctcaatcgcctcctattaggagtaaggtgacgaggactcgtcaagcctctacttccagggttgtaaagaaagtgagcgctatccctgaacaccacctatcatccattcaacagggaattttacaggctcaaagggaaggtgatttggacgccatacacttagcctttccagtaaccgtcagggagacagtggctccaggcattgatcccgccaaccctgatggagtttatgagttcattcatgagccctttccttttaaaattcttaaagaattaaaacaggccgttcaaaactatggtgttaattctccctttacaaaaggaatcgtgcagggagtagctgaaggaaatcgtatgattcctgctgattggcatagtttaacccgtgctgtgctatcacctagtgaatatttacaatttaagtcttggtggcaagatcatgcccaaattactgctaatcgtaatcaggttcgaaatcttccaattacaatggaacaattgttagggattggtccttggagtaatcttcaagatcaattaagaatgaatgatttggctatcgaacagattagacaatgttgcttaacggcatgggataaaattgaatctacgggtcaaataaatatttcttttcaaaagatcctacaaggccctaaggaaccttatactgaatttctagctcgtttacaagaggcattaaaacgacaagttactaactctgaggtgtctgatactatttttcaattgttagcatatgaaaacgcaaacactgattgcaaaaaggccataggatttttaaaaggaaaagctaacatagccgaatatattaaagcctgtcagggagtggggacggagtcctttaaggcctcaatgctagcccaagcaatggctaatttaaaagttaaagacaaattttcagaaaaatgttttaattgtggtaagacaggacatattaaaaaacaatgtcgcgctcttccacgagcccgacctttctctcatggagcttcagcaccttctagcaacaataataaacagcccagactatgtccaagatgtaataaaggaaatcactgggctaaccagtgccggtccatctttcataaagatggaacccccttgttgggaaactaccctcggggcaagcttccagccccgtcaaccaaggaagcattccccattcggaacaagagccagactccctggaactacgctctgcaccagagttcgacatcacagtagatctatttaattctccttcctagcgaaactcctacttctattacaaccaagttggaaaatccattaccatcagatacaataggattgataataggaagggcagagctaacagaacaaggaattcgagttcataccaggatattggataataacggggatgataaagtacaagtgatggtttccactgcgattccttggaaaattaaaaaaggggatcagattgctcaaatcttaattttacctagagtccagaagaaaaaagacaggaataattttagacagaagagattcaataccacaggaggggcaggagtgtttttatcagaaaaggtcctagaggaacgacccacttgtcaagttatcataaatggaaagtcttttagaggattgattgatactggtgctgatgtttcaatcattagccatttacattggccagacacctggcctcttcagccagctgatattgaagtcactgggttaggaaaagcagagggtctcaaaaagagtgcccaatggcttaattgtgaaggaccagatgggcagccagctagattgaaaccttatgttgctcaactccctatcaatctatgggggagagatttattacaacagtggcatgcagaaatttacttaccgccagtagatcaatatagtcatcaaagccaaaaaatgttgcagaaacagggttacattcccggattgggattaggaagacatcatcaggggagagtggaacctattgaatctgagattaaaatggacaaatctggtttgggatatcggccttttcattagcggccactgcttgtaaaaataattatgtttctcctgaacctattcgactgaaatggactacagaaaaaccagtttgggttgagcagtggcctctttcttcagaaaaattaaaggttttaagtgatctggtccaagaacaattagagaagggccatatagaagaatcctttagtccctggaattcaccagtgtttgttatatagaaaaaatcaggaaaatggagattgttaacagacttaagaggagtaaatgctgtaattcagcctatgggtgcccttcaaccaggcctcccatctcctagtatgataccagctaactggttgttaattatcttggacctaaaagactgctttttcacaattcctttacacccagaagataaggaaaaatttgctttttcagtcccagtggtaaacaatatagcccctagaaagcgttatcaatggaaggtccttcctcaaggtatgttaaacagccctaccttgtgtcagtattatgtggcttcagttgttgagccagtccgaagacaatttcctaaatgctatattgttcactatatggatgatatactttgtgctgcaccctctcaggagcagctgactgaggttttccaatgtttacaaacctgtctaaaaggagcaggattggttattgctcctgaaaagattcaaatgaaaagtccatatcaatatttgggaactgtggttgaacgtaccactgttcaccctcaaaaggtagaattgagaagagatcaaatttctacattaaatgatttacaaaaattgttaggagacattaattggctccgaccttatttggggattcctacatatgaattgtcaaatcttttctccttgcttagaggagattctaaattaaacagcccccgctctctaactgcagaagcggaagaggaactaaaaaagattgaaagtaaaatacaaaactcccaactaagtcgggtcaatctaaaacaacccattcagttagtaattataccttctcctcattctcccacgggaatattaatgcaattagaaaatattctcgaatggctttttcttcccaataatgtcacgaagtctttgtctccatacctggacttgatggcacaacttattctaaaaggtcgcactcgctgtgtacaaatgtccggaaaagatttgaatcatgtaattgtcagtttaactattaaggaaatccaaaattgttttcaaaaccatataggttggcaaattgcctttgcagattacgtaggatcaatagataatcactatccaaaaaaccctgttttacaatttataaagcgtactcaatggattctgccaaaaaaggtgaaggagtcacccatcattgacgcccctgtgatctttactgatgggactagtaaagggaaggccggatatgtggctaatcaatctaaaattataagaacacctggcctttcagcccaacaggctgaactaactgctgtaatccatgccttgagggactatcctgagcctatcaatattctttctgattcagcatatgtagttcatgctgccaaaatgattgaagctgctaccattaaacaaaatttacctgtcttgttatttgacttgtttacaaaattaccaactgttgtaagggaaagaagatatccattttatattactcatatcagagcacatactaacctacctgggcctctagttgcaggaaataaagaaattgactgcttggtgacacctgtgttacaagaagctcaacattttcatgatttaacacatgtaaatgttcgaggccttaaaaaaagatttggaataacatgggctaaagctaagacaattgttcgtcaatgtcctgcatgtcaaattattaacaatccttctcaatctgagcctggagttaaccctagggggcttgtcccaaatgctctctggcaaatggatgttactcattattcatcttttggaaaattgtcatttattcatgtatgtattgacacttactctaaatttatttgggctactgcgcagtctggtgaatctgctaaacatgttattcgtcatttgtatgcctgttttgcagtcatgggcctgccacaagcaattaaaactgataatggtccagcttatatcagttctcaacttaaaacattcctagatacatggcatattgctcactctactggtctcccttacaacccccaaggacaggctattgtggaacgagccaatttatatgtaaaacaggctcttcaaaaacaaaaagggggagacacagaaatagttcaagtcacaacaaacacttttaaacaaaaccttattcactttaaattttttaaacttggcctctgatgaaaaaacagctgcagagagacatttttatacagaacaaaataagattaactttcctcatgctgaacagcccttgatttggtggcaggatccactaacaaacttctggtctccaggaaaacttattacgtggggtaggggatatgcttgtatttcaccaggtcatggattacaacctgtttggattccatcaaggagaatcaaaccatatcatgagcaagcttgtgaagcatcccttgactccagaccccagaaggaggatgatgagggctcatcttcctcatcttcccacttgaggtcagatcaaacatctaacccaagaaagctgaaatctactaagaaaaggaaagcctctcactccaaataatttggtcctagctctctttactttggtttccatcgcagtgagtattctcacaactggcatagaaatcattttattacttgtatagtacagggattaaaagcctcatgagtaaaacccattaaaaactattgaagatttaatgagagagtccatcagctttcttagcaagactcagaagggcattgagaaaacatacaaaggaacccagaaacaatggagggccaaataattcttaaggataaattcatagctcagtcggtgccagatatatggagaaagctccaaaaaattggcttttggccctgatcaggatctggagcacctcctcagagtatgttataattggggccaggaagaatgaaaggagaacaagaagagagcctgagaaaaggctgaggctctagttatggcactacagggagtcaacctgggagtttccaaggtgagaggactagggcagagacctatgcccggagtctgtttcctctgaggaaaagagggaccctttaaatgggaatgccccaagactcagatcactggaagagggattacccctgaagacgaaggtctctgtggttgacccctcaagcccaggatcaagactgatggaacatttccataatggctcctgtccttatcaccactcagccctgggtgactctaaatgtaggaatacagagccacttttcagtcctcctctccaatcctgggcccctccctcatgaatctgccacatttatatttctggcaagctggttacaaaattctttacacaacctttgagttgtgactgggaatccattttcttttctcaatacctttctgattgtttcagagtccaacttctcttttagaaattcttaaaatatggaaggtaactacatacatgttgttacagttgtcaacattaggtataacatattatcgtacctaggtttaacagaagtcaaatgagacactgaaacatcaattactaaacagaaactaaaggtctttagaatgatgaaacaatatgatcagtgccatcctgagatggtctctataagaaaaacatgtgtttttagaaattataaaggagagtccatggttgctttagaaaagtagaatgagtatgttttcaatatagatgaaatgaggaatggaattgcatcttattaacgcaaaagaaagatagtctgtcttcagctgattgctctccttggaaaataagggacatctaaatgttgtattcctgattgttcacagaatgtgtctaattccctgctagatcatcatcagtagattcatgagctgtcaatccagctccagtttttggagctgccctgtggaaccagctgacctcctcctcctggtgaaaatatttctttgaggtatccaaagcaatgttatcaaagcccacttgaccattccatgagtggagacctaactgctttccctaacgacgccccttttcagcaggaagaagttagagcggtcgtcgccccttttcccacagttagagtctccaactcaaaggggggaattaaggtagatttttaactcaggtagtcagtgtagggatatgggctttgatacattctttgtagctatttattaacatttgtaaattgagggtcgcatagcaagcccaactgctataaaggttgtgggtattgccccatggatccatcacattagagtgaagaaggttgcatccgctgctgacatggacactggggaggctgtacagcacctcaagaatctcttcatggtcaagttccagagactccttttgccatcatcagagtgctaagccctgctctggccacccgtggaagctggtcagtctatgcacagcagaagtccgaggagttccacgtgagacttaaaacttgaactctgagacttaacttggactgtgttctaagcgaataattcaagaagaagtgaaaaaagtttcaagaactatttttgtcttcccgcaaaaacaaaaagggggagatgttgcaagacatgtttccttgaaaactccatcttgtccttccttactttatcccatcttccttcttggaaaaacagtcacagtgctggtaaatgacttaagcttaagagcaaagacctaaaggcataaatgacttaagcttaagtactgttatgtgcctagaggtcagagtaagagcttaaccctttaccacctaagtggctttctaaatagtaaaagaacttatatcatccacccatagccactcctcacttaatctcacaataaaagcagtgtggtttcttgaggcagtgctcttggtcccggagatctggagttccccggcgctcttggtccctgagaccttgagtcccgcactcttggtccctgagaccttgagtcccccggctcccacctttacttaagataaatgtctctgtgtcttgttttatgttaactatttttccttaagttccacagcacccgttcttcccca

SEQ ID NO: 66 - DNA, 7097 bp, Artificial
  ss351 sequence
tgtctgcttggggatgggggaggttcaggatgcttacatgggaaaatcaagaccttgtagtgtataaaagttactgagaacaaagacctggtgctcagactctggaggtgactcctctgagcccacaccggtgctgaataaatcttgcttttccatatctccaagcgctgtttgtctccttccattgccacagtttttgcggttcccgcaacattttggtgcattggcctggaagccaacaactgagctggcatcttgtgccaccattgttggggaaccgggggaagccacggtcgccagcctggtgacaggtggatagcactcactggccattttgccagatccagaccctcattcgggccgtggccctggcccacaccgcttcccgaatggactcagaaggagagtggaaacaggttccaggacaggacgtcggactggtgagtgccctggggacatctgcccaagtcaggacctgccatacgacagaaggagagactgatcacctcttagtgaccaaagggtcactcaggtcagggtttgctcccttgggatcaggaggcttgtcaattctggtgtgtgtgtgagtgactagagagaatgagagcccgtgctccaccgtttttggactacggagccagagtgagtcctaacctgcagttccatggcgaccctcatacggcttatgatggccctcttcggggggatcctgacattggggtttatacagtcccacctatgctaagaggcgcctgaaatatctcctctgggggagcggtcaggtggacaaagcgattgttatctgaggccttgtcctcactgtttgtcttgtgtcaccggcatagggtgggacttcacacaatgggtaaattggcttctgagcccgctgtcttagagtatatgggtaagaattttaagaaaggattttctagggattatggtgttaagctgagtcctggaaaactgtgtaccctctgtaccctagagtggccctcctttagtgttggctggcctccagaagggaccttagatgtgttcacagttatggcagtatataatgttataacaggaaaccttggacacccagaccaatttctgtatattgatcaatggttggaaattgcctatttgatgcccccatgagttcagttctgcaccacagaccagggacagtgtagggtgttagtagcccagtccaagaagaaaatcttgtctcaaaaaaggtgccatctatttatcaaggggaacctgaggactcaccccctatgccaccaccttatgtgctgctggccccacctccaagagccaaaggtccccagatgtcatatagcccaccggcttctgtttctcctcctccttctgcttctgaagttcctgaggtgatatcacccccacagccagattctccagaacctatgagcaggcgtctctggtcagctcagggagcagccactccagcattacaaatgcccttatgggagacacagggaccccagcaattcacctccaatgggaccatacaagaggggggacatttttattattaccagcccttttccacggctgatctcctcaactggaaacaccatactctctcatactctgaaaagtctcaggcgctgattgatctcttagaattcattttccagacacactggcccacctggatagactgctggcaactcctttttactctatttgacactgaagagtgctggtgaattgtaacagaagctgcaaaatggcttcaggccaatgcggggggtcgagcagacttggcaaactgggtgaaggaagtcttcccagaagaaaacccccactggactatgacactgaagaagggaaatgtaacctagataggtaccggcaggccttcctacaggggggcaaaagctggggctaaaaggcccactaatatagctaagatcagtgagatactacaagagccgaatgaaagtccagccaaattctatgagagactatgtgaggctttcggaatgtacaccccttttgatcccgaggcccctgagaaccaacggatgataaatgctgcctttgtgggacaagcccaatcagatatctataaaaagctacagaaaatagaaggatttgcaggagagaatgccactaaattattggaaatagccaacaagatttttattaaccaagaccaggtggcccaccatgatgcagaaaagagaatgaagcaaaaagtgactcttctggtagctgccgtgtcaaaactggtgcccccagtgggaccaccccgtaggggccaaggcacaaggccagggaaaaggagtcccctaaaacaagaccaatgtgcttactgcaaagaaaagggacattggaaaaataaatgccccaaccctcctgagaaaaagaccaaggccccacctagcctgtactgatctgagccattcagcaccaacctgatcagtctagctgagtctgattaggggggaccaggctctctccaactgggcccccaagagcctttggtcagaattcaagtagggggccaccccatagactttatggttgacacaggtgccaaactttctgtggttacacatcctgtggctcccctctcaggaaaagaaaccattgttggggccacaggtaaccaaacccatagacccttctgtggtcctcgatgatgtcggttaggaggccatgaagtaatacatgaatttctttacctgcctgactgcccagtccccctgatgggaagagacctgctggctaacatggggacaaaaatttccttttctactgatggatcagcccaacttaaattgacagaacccccctctcctttaatcatggctcttgctgtaaaaaagggaagaggaatggtgtttgtactcttccccttcagaaatggggaccattcccacagaactagagactaaatacccattggtttaggctgaaggaaacccaccaggactggcaaaacaccacgcttctgtcttgattgatctaaaacctggagcttaaccgataaagctacggcaatactcaattcccagagaagctcaactgggaatccaggttcacctgggtaggctgcttcagcacggactgttaataaaatgtcagtccccttggaacacccctttactgcccgtgaaaaaaccgggaacacaggactatcacccagtacaggacttcagagccataaatgaagcaacagtcacattacacccctctgtccctaacccgtataccctgctagggctgatcccctccactgctgagtggtttacttgcctggacttaaaagacacctttttctgcctccaggtggcacctgccagtcagcccttgtttgcttttgaatgggaaaatccacacacagggacaaaggaacagctcacctggactagactcccacaagggttcaaaaactctcccactctttttagcggcaccttagctgctgacctggctgaatttcctggacaaaaactaggctgtgttttgctacagtatgttgacgacctcttactagctggcaccatggaggctcagtgcctcgagggaacaagagctttcctttccctactgatggaggcagcgtatcggtatcaaagagaaaggtacaaatctgcaaaaaacaagtcaagtatctgggcttcaacatcttgcagggccaacaaatgttggggactgaaaaaaagcaggcagtttgtgtcactcctgtccctaccacccgccggaaggttcgtgagttcctaggggcagcaggattctgccggatatggatccccaggttttcagacctggccaggcctctgtatgaggctctaaaaggaaaaaaaaaaaaggctccccttgaatggggaccaagccaggagacagaatttcaaataatcaaaaccaaactcactgaggctccagccatgggacttcctgatgtaaccagagaatttaacctttttgttcatgggaaaaatgggatggctttgggagtcttaactcaagaatttgggccttggcagaggccagtggcatatctgtctaaacaaattgactcagttactgccagatggcctccctgcctccaagcactggcagctaccaccttgttggtaagagaggctgacaagttgaccctgggacaaaacctcaatgttaaagtcccacactcagttgtaaccttaatggataccaggggccaccattggctcacacatgcacaaatgactcaatatcaaggcttactatgtgaaaatccacaggtaaaactggaggttgtatgaactctgaacccagccacttttctgccagatggagaggggccccacagaccagctggggcacagcactgtggaatgtccccatttgaggatatggaagtggacttcactgaggtcacccctagtaagggttaaaaatatttactagtttttatctgaactttttcaggatgggtaaaaaccttccctaccagaactgaaaaggcaagggaagtaaccaagacactcctgagagacattattcccagatatagaatgcctctgaccattgggtcagataatggactggcatttgtggccaaaacagcacaacagttggcaaaagctttacagatccgatggaaactacactctgcttatcaccctcaaagttcagggaaagtagaacgcatgaaccgaacccttaaacagacactggcaaagttatgtcaggaaactggcttgccctggatagacatgttgctggtggccctcttaaaagtgagatgctcaccccgagtgggaataggattcttgccatttgaaatcttatatggaaggccacctccactaatcagtttaaaaggaaacaccagggagttgggagacttggaattatataaacaattacaaggactggggctcactatttcttggatacataaatggatcacagacagaatacctttgtccttaggtataacagtacacacccacaagccgggggaccaggtgtggataaaggactggaaaaaggagcctttgaggccgttatggaagggcccctatactgtaattctaaccacccctactgctcttaaagtaacaggaatagatgcttggatccatcattctagagttaaactggctggcccagctgacgaccgtgaagagtgggagactgccctcgatccggagagacctcttcacctgacaatacagagaaggagacaaggatctcaaagccctgctctgaccacaccggaagctggccagtcaatgcatggctgaagcttgaggaatcggcagtctgtgagcccaaatggaaggagggtttcaaaataaacattcacattgatggaagaggccttgaccctggagctgtgctacatttccagagaatcacgtttgcactccaagctgcctctcacagggtctttcattccttttatgaagagataaaaaacaccctacctcccattccagccacaactaagaacttgttcttagccccggcagaaactattgcacaaactctcaaggtctcctcttgttatgtttgtgggggaacgaacacaggagaccactggccttggcaggccagagaactgaacccattagagcctcataatgagactgcatacccccaactcactgatggggcatggctcctcaaaactgctattattaggagaaattgtcttgtgaggtggggaggatggtttaatgtttcagttggaagcctaacatgtttaggcctaaggtattaaaacctgactgccctaaagactcaatgttggtcatcctccaatctctcagagcccaaacataatcccttgtctaacttttccttcctttgacaagcatggaaagatatcagtactaatacccagtggcaggcaccaaagggattatattggatttgtaaaaaaatggcctattccatactccctcccaaattgggctggggcatgtgtactgggaacaatcagacctttcttcttcatgctcctgctgtcactaggggagcaactgggagttcctatatatagggcacagggtgcccagagagaccagagggctctccaaattagagactggaaagatgataaatggcccccagaatggataattcaatattatggacctgccacctggctatatgctgaaccacatcatcagactacaggcggttttggaacttataacaaatgacactgcaagggccttgactatattggtccaataacaaactaaaatacacagtgcaatctacaaaaattgcttggccttggattatctacttctgaaggaggggtttgtaaaaaatttaacttaagtaattgctgtcttcaaatagataacactgaaaaggtggtaaaaaaaaatttctgactacatgactaaacttgcccatatgcctgcacaaacttggaaaggatgggatacagacagtctctttggtaaatggttctcttggttgggagaaattaagacaatggtcagaataaccatggttatacttgaagggtgcctacttgttccctgctttgtacctcttctgataaatattataaaaggttttataaaaaccatggttgaaaaacaacggcctcccacctgctacttatcagaggcttccaaagcgttatgactgatgatgatctgtaaagggtgcagatgcaccctgaacatcaagaggggggaatgaaatggagttttaactaaagaacacccccccttggctaagaaggtagctgcaagcctttccagctgtgctcatcactataccacccttcttgtaataatgtaacaactgtgtgccctctgtccaagccagcagccctgctaatcatgtgcccagcattgcttatcagttctgcttctgtaaccttgcttgctcagtttcttagggaggaacactgtctgcttggggatgggggaggttcaggatgcttacatgggaaaatcaagaccttgtagtgtataaaagttactgagaacaaagacctggtgctcagactctggaggtgactcctctgagcccacaccggtgctgaataaatcttgcttttccatatctccaagcgctgtttgtctccttccattgccacagtttttgcagtttctgca

SEQ ID NO: 67 - DNA, 9716 bp, Artificial
  ss352 sequence
  misc_feature (7749)..(7750): n is a, c, g, or t
tgaatgagtaaattctagacatatacatattggggttaaagcttacaataatattattatattatgaataatgttcaagttataatttcctatcatatcttcaccacactataaactcatagtgcactgagactcagcttattcctaggaaacaaataaccattggtaaatcccatggggcctaaactccttgatttagcatacaataaggatacttatggggaaaaattattttttaaaaatagcttgtgtacctgaactgtctttatctgcttataattcattcttcccaaggccacttcctaacctgttactgaaactcttctatgcattcagcataaatagaagttcatttcatgtaaaattctgcccaaaaaatctgtcttattcagagctgaaattaaatatttattgtttttactcagttgttatgaattcatcctccaagatcaaatgtagcacttaattttccttcacatatgtaatgatattgtggtaagggacctcccagaacaaagggaaggcaatatggcataatcatcatctatgtgcacgtgcataactgaggcagcaagacataatcaatatccatgtgcaaatttttcatgtagaccatccaaccagaatttacagaatgtaggttataaggggagcaaagagaccaaagtaaaagaaaaaataattgagggcatataagacagcctttggatgtgattctggtgaggggctcgtattggtaagcctacacctgaaaggcagaaggtgagtccaatcacctccccagatttgcccaagtagtctcaaaggagatgaaaccatgactctaaggtgctgggtggcaggttggagatgtgtgaatgtgagtgaatgagatgtacaacaggagagttctgactcgaccaagggctgaagtgagtgtggagtcctgtccgtggttacatgttaatcctcatatggcttatggtggtgctctttggagagatcctgatgttggagtttatacagtcccaccaatgctaagaggctcctgaaatatctccatgaggagagctgccagagatggaagaaatgattgatctaatgcaatccatcatccagacccaaaagcccacctggactgattgctacagctactcttgacactgttcagcactgaggagcactgctgaattactcaggccactttaaaatggttagaggaacacaccccaacagggacagtgaactcacaggcttacacccaggacaagttcctcaagaaaaaaatgccagtgggaccctaataaaactcagggatttcaaatgcttgataactactaagagccttttttaagtggcatgaagaagggagaggaaaaggctatgaacatgagcaaaacctcagaggtgctccattgacctaaagagatcctaagccagtttgagaggctatgcaaacatttcacctttacactcatgtagacctggaagccactgagaatcaatggatggttaatgcagcctttgttgctcaggcccaaggagacatctgacatgagctacaaaagttagggggtttcactggaatgaatgccagacagctgttggaggttgcaataaaggtatttgtcaactgagaccaagaggcatgatgagaatcagaagaaaaaatgaaaaataagggaagatccgcttgctggccccctagtggatcaatcaggacactcccagagaggtgctccaccaagctggggcccagatcagaggaggaacctacaagggggacctcctcacccagagatgaattggaatgtaatgaatgagcttacttctgtcaggaaggttactggaagaatgagtgtcccactggtcagaaaattacccagctcctggatagagggagagaggctaggtgattcaaggacagtaccaaccagtgcagttaccattagaagtccctgatgacaattttgttggtctggctaccatgggaaactatgagatagaccaggacagaccaggctacactttgtttggcccccatgagcccacggtccaaataactgtaggggggcagcccattgactttatggcagacactggggccgaacattctgtggtgactcaacccatgggtcccctctcacagagacaagccactattgtgggagccatggaaaaccaaacccgtcatcatttgtactgccttgatgcaatttaggtgaccatcaagtctttcaccaattcctataactccctgactgtcctgtggctttgatgtgttgggacttattgggaaagctgcaggcccagaaaacatttaattcccatggccaagcagccctgacactagggaaactggcaaaaatcatgactcttacaatcccccgaggagaagagtagtgcctctacagtcttacagagaggccacaataggaactgagattctcctcatgctacctagagtatgggctgaaaatgaccccccagatttgcctgaaacacacttccagtaatagtagaactaaaaccaggagtcaaacccacctgccagaaacaatatttcatttgtcacaaggcaaaagctggaatccagaaacactggagagacttctaaagtatggaatcctctgaccctgccagttgtcttggaacatgcctctcctgccagttcagaaaccaggaatagatgactaccagccagttaaggacctgtgagcagtaaaccaagccactgttaacctgcaccaagttctccctaacccctacactctcctgaagcttatcccctttgaagctgccttcttcacatgcctggacctcaaagatgccttcttctgcatccacccccgcccccgaatcaaccaatctttgtcttccaatgagaaaatctggaaaatggtgaaaaggaccagctgacatgtactagagtgcattaaggattcaaaaattctccaacaaccttcagaatttcattagcctctgatttaaaagccttcccagcaaaccagcatggctatatgctactccaatatgtggatcatctaccactggccaggcaaactcaggaagaatctattcaagggatgtgtctgctcctcaccttcctaaaggaggctagctacaaggcttaaaaggaaaaaggcccagatctgtcaagaaaaagtcaaataccttcgctttcacttatcccaaggacaatgtcaactcggtccagagagaaagcaagctgtctattcaatcccggttccatctacccaactccagtttttggaattttggggggactgcagttttctggagaatctggattcccagcttctccatcttgacaaaacccctttatgaggccacaaactggggtgaacaggaagctttgttgtgggaaagagtgccacaaaaggcctttgaagagatcaagaaggccctcaccaatgttcctggcctgggactctcagacatctctgagcctttcttcttgtatgtgcatgagcatactggtattgcagtgggagtcctgacccaaatgtagtggtcatggcatcatccagtggcacacctctctaagcaacttgactccattgcctaaggatagccaccctgtctatgggcacttgcagccatggctctcttagtgtcagaggctgacaaaatgaatatggaacaagaactaacagtctgagtgccacacttggtatggacattaatggagtctaagggccaactaatgctcagagggtcaaatatcaggggatgttatgtgaaaacctgcacattcaccataaaccctgtaaccctactaccttttgggccgggtcagccagatcatgattgtggtgaagtcatggatggggtattctccagccaaccagacttaacagacaagcctctcaaaggcccagaagctgagtatttcactgaaggtagcagctttgtaaaatagggagaatgccttgctgggtattcctttgtgaccctaaattccaccactgaggcaaagtccctgtcaaaaggaacttctgcacagaaggcagaactcattgcactaacctgagccctccaactggcagtgggcatacatgtcaatatatacaaagactctaaatatgtcttaactaccctccatgtgcatggggctttatacaaagaaaagggtctaatcaactcagaaggaaaaggtaaagtatggcaaagaaatgctcaaaatcttagatgctgtgtgggcccctaaaaggatggcagtcatacattatcagggacatcaaaagggagacaccatcgtcattctgggaaaccataaagcagaccaagaagcaaagctcacagcctccaaagggacattggaaccagcagctctgattgccacactgttccctagtccatttgcagaatgggactctaaatactcacaacatgaaaacacttgatttaaaactaaaaatgagaactactccctatgtggatagtagaaattttaacatggctgggtatcagttcctaaggcctaaccccagcctttgtcagtttcagcaggagactcacattggcctaatggctctcgagaccacagtgggccaaaacttctacatctcttggcttgttggaagccataaggctgctccagtaaagaaaacaaagccacagtcagcacctgcatgaggcttgtctggttagcagagctaaagacaagctgaagaaagaagaaggattgcagagcaattccttgaaaaacctcggtttcctggaaaataaaaatgatatcccctaaaaaatatgttaatctatttttttctctgtttatccttctttttctatctttgattcacagccttttttacagctaagtatttgccctgggtacccgtaaaacgcctgaaccaaaacagagtgaagtcatttaaacaatgtaatggaaaaagcatttgttttggagtaacaatttatggcacctattttgtaagagtatacaggggcaacttatgatttctgtcactttacataaaaagaagtttggggctgggaaaagtgttgtatggcctacaaattgctattttctacaacagatatattttttattaaataacaatgtcacctgtaacttccatcccttgtgggggcacttgataattttggggcataatactcctttctattgaatttggtggtttggaacttgtgtaagtcaggacaatatgttaaatgcttagcttgctggagccaaataaaccgcagcctcaagaatgtcatgagcctaaggctttcttgcgtttttgttaactatatacgccttgagttaaagaatgttaggtatcatagtttattacttattaaagctttgttcttaatatagaatagaatagctactgttattgaccttttaagaaaaatacagtgtgaaactttaagtttgtaatcttgaagaaaaatctaaagttgaaaggaacacgttttaactaacctttttttgtatctcaggtggagggaacagaaagggctttaaatcaaatgttaatgtcaaatcttacacaaaacttgattgtgaaatggtataaaagctgatgcttttcatttaataaattgggtcatctgcagcatgcagttgaggagttggctccaattctgtccacgccatttgtagcccatcctctccttcgacacttcctggctgctggggctggaccctggcattggctttccagcatgtcccaggtaatatgaaaataatatgaaatgtgtgccccaaataacctgtgtcagggacctaaggccacccctggagtacagagagttggaggagcatcatttgtaaatattgttgtggacttcactgagcttccccaagtctgaggctatcaatatctgttagcctttctgtgtagtttctcagtacacagtggaggccttccctacttgcacagaaaaggcacatgaagtagcccaacttctcctaaaggaaatcattcctggttttggaatcccaatcaccatgggatcagataataggctggcattcatggctgaggtggtgcaattgctggcaaaggggttgaagatgacctgtaagttacacagttcatatcatccccagagctctgggaaggttgagtgaatgaaccaaactccaaaattgcaacaaagtaaactgtgtaaggagacccagctacaatgggaccaacagtttttgattgctctgttaaggattaggtccagccctgctagacagacagggttttctcattatgagattctttacagatgccctcatcccattatcagtggtatatgaggggatctaaaagaattgggcaacattaccctgaggcagcagacacaagctcttggctcaaccctaaccactacacaccattgtgttagggaacagatacctgtgatcttgaccacagatatccagccctttaaatcaggagatgctggatgggtaaaatagtagaatgtccaacccctaaagcccctctggagggggccattcactgtcacttcatccactccaatgcagtgaaggtagccaagtggtcccttggattcaccacagcagagtgaaacctgcttccaaaggataggaatgcacttcttatccatcaacaccatgcaggctgaccatccagaggaagcagattgcaaccccagagaccctagaggactgcagccctgctttagtcactctggaagctgactaatcaatgcatggcagaagcttgaggaattggctgcctgagtggaaaaatagactatttttgttttatacttgggttctcttactctgattaactgtcatcccttgtacctgtctgttattgtgatccacaccctaatttttaccatagggttggcagagactgctccagctggatggaagtgtgatgaaagttttctgctagcactctcctcttgagggtaggatttttttttactattggttgcctctgatttaggcccttttttgtagacctaagctccccatcatgtgacccatgcatccacactattgaacatgatgaaggtgtcacaaggaccttactttaccacactcatttcacttgccagggagaagtcttggggacctgcaaatgagacaagaccacctattctagctaccaacaagagaatcagtacacttgctttgacccaccgtactccccaagggaagagtggttaggtgtcaggcacacctgagatgggggaatttaattagctgaacccaggttactaatcctcacctgtcagtgttgatactttttgatgtatgtggggccattggtaatacctgtacatggttaaatcatactattctatgtgagggcctacacttggaatgagagtacagacttaaagaaaaatatatgtgtgaaaagtcctggggaagatgtgatgacctggactactcttactgctcctattgaagctgcattgcatgggccccttggaaagatgaagacaaaacagcactcctccaacagggtatagccaaccccaccttacattaggagcctgcaaccccattaattttactaccctagacccagaagaccctaggtgggaaaatgaccacaagattggtattcacatccatgggcaagacatctgcccaagaactatattgtacttaatgagggccacagttccactctgagcctcaactcacaaagtctttcattatttttatgaggaaatagaaagtagcccacctaaaatctctatcaagaccagaaacctgtttctagccttggcagaaactatagcccagactcnntaagtttcttttctgtatgtatgtatgggagatcaatggctatgagacgccagagagatagagccccatgagtcttataatgaggcaggataccccaaccctgctaatgggatttaggttcttaagactcaatcataggaaacaactgccttgtctgatggagaggacaattcaacaactctgttgggagcctgatgtgcctgggccagagattctataatgtaaccacccagaaatacaaatggtgtggatccccaagcctttctggaccaaatcctcacccctacccaacttctctcatctctgacggtcctgggatgaggttgacactaacatcaaatggtgggccctagatggactatactggatatgtgggagaatcagcctatactgtgcttttccaaaactggtcaggatcttatatgttggggttgatccatccatctttcttcttgatcccactttccagaggggaacatttgggagtccaagtgtattaagacagggagacccataaaaagtggcatgctgtatagattggcaattggaaagatgatgaatgtcccccattactatggtccattcaccttggcagagagtagaccttatggatattgtactcccatctatatgtcaaaccatatcatcaggttacaagctgttgttgaaattataactaatgaaactgcaaaagcctttaatatactagccaagcagcaaaccaaaatgcataatgctatctatcaaaaccacctagctttagattacctaactggcttctgaaggaggggtttggtgaaaatttaacctgagtaactgctgcttacaaatagatggtgtaagcagtaacctgagtctgctgcttacaaatagataggtcacagaggaaataacagattgaatgagaaaaatcattaaagtccaaatccaaacctggatggttttcaactgtcaggggattcaaaaccctcataggtgttgtgttttaaatttgggggcttgcttcatcataccctgtctagcccccctagttatacagtctgtctccagcctcattgaggccatggataagatcaagaaactaagtgcatatggcattggaataattatctttatgtctgatgaaaccaactcaaagcaagaaatccccaaacaagtaaaaccatattgtaacaccttaggagcactgattcatctttagagactttgaggtggactaagtttaccatctgatatttatgttatagaatgatgtccagtataataaaaatagtctggagataatattaagtttatatccaccacaaatccctctaaatatcttatattttaaagatgccaaaggggtaaaatctttttacaatttcagtatgtggtaaatgtagctgatgaagtatgttattctactgtagggaatatctaaaaatgtgggtagagaaacatgtgattaagtgtaagaagttaactggaaaggaaaatccagaaaatgttatagcaacaacagcaaaataaaaattgaccattttgctgcatcattaattgtctttcatcaattgtgccccacactgtaaacacacagagactcatctttagtcctaggaaacaagtagccattgggaaatcccatggaatttaagcttcctgaattagcatacaataaggatacttatgggggaaaatgtgcattgaattcttttctaaaaataacctgtgtccctccaaaatgcctcaactgtctttttctgccattataacttattcttctcaaaggcatttcttaaacttttagcggaagctttttaagcactcagtataaagagaagttgtttccacataaagttttgtaaaaaatatgtatacatatacatgtcttatttggagctgaaataaaacatttattttttcagtcagtttttatggctttatcctccaaaagcaaatttagcatttgaagttttcccacaca

SEQ ID NO: 68 - DNA, 8090 bp, Artificial
  ss355 sequence
tgacctgaccaatgggaaggggacaggtaagtcacctgcattaggaataagtaggggaatgtcctttgtttggtgcatgaaatttttggagtacctgcacccttctgcagaagtaaagagccttgttaagatttctccttatttacatgtcttgctttctgatactgatgaaccaagccagatttttcttaattttcagattaaatattgctgttttatctggatgcagacacctgttctcgctccatctgtcttctggtcaaaatttggattggatgagaattgggtctgtcagctttttattcagtttgtccacaaaaagacaccagggtctcaggaggaaacttattatgctctctgttggctccagggactggtagtcttatttcccctcagagcatgggaccaagatggaaatgaggaggaaaccaaagaacattctgggacctcctcccctccatggacccccatggctcactgccactaccttgcaatcaccaaaatggtgctggctcccctcctgccacagcttccaccactgctactgccaggggagcatgagatggggaggggggcagagcccaccgcccaggtgcaagggcactgcctctggccatgcagttaacatgggagggagaggggtgcataacccatcacacaggtgcaagcacactccccccactagcagagtcagagcaggaaggtgatgagcctagaacccactgggcaggcacaagagcactgccactcttcagggaatcataacaggagaggggcaccataggcataggcacactgccatggcccatcggatcaacacccagtgcctcaacaaaaccagaggatatggcagggccttattccagacttaagagagagttaaaacaatgttaagaagatattaaaaattttccttttcccactgctacccctggagatagacaagaagggccacaaatgctcttcccactatgggaggttcccctaggtggggaggaataggatatgtaaatgcccctttaaccagcgccgaggtccaaaattttaggagagaattgcaaccattgttggaagacccatatggggtagcagatcaactagatcaattccttggaccacaagtctatacatggtctgaattaatgtctattttgagaattttgttctctggggaaggaagggggataatttgaagggcagccatggcctcgtgggagcaaaccaaccctccccagacaggggaagttagggcaaaaacaaaatttcccaacaaggaccccagatgggacaataacaatgtagtccaccaggggcatatgatggacttgagaaatctaataattcagggaattagggatgctgtacttcaaactcaaaatatatctaaggcatttgaggtacagcaaggtaaagaggagggaccaactgaacttttggaaagactcaattcagatgagaaaatatggtggaatagattccactgaccctctgggacggggcatgctccaacttcactttgtaagtaatagttggccagatatttccaagaagttacaaaaaatagaggattggaatgataaaacattagaggccctattaaaagaggcataaaatgtttatatgagaagggatgaagagaagcaaaaaacaaaggacaagatcatgtttgcatatcaacaaaaacaagacaggtcaaatcaaaggggtcctaaggacaaaagtaagagaggttcacaatatcagcctcactgatacccagaaacagggcaaaagggaaaggggaatagatggcaaggtgaaaacaagtgctttaggtgtggcaaattgggacatttaaaaagagaaggccctgaatggaaaaaggaggataaaacaatccctctgatgtaatttgaggaggatgaggactaggggggtcaggggctctccatagtgattgaccaacttaaaaacccacaagtgctctacccagagcccttgataaacttagaggtagagccataccatgaaaccatgatttttcttattcattcaggggcatctcttgcctcactttgttatttgcccaaagggctttctccttctcatgaacagatactagtatctggggtaaaaggtgagggattttcagcaaaaattttagaagaaaccaaagtaagtttccaaaacagatgtgccaaaatatgcttcctttttgttccagaggctggcacaaacctgtgtgtaagaggcctaatggttgaattgggactgggcttacaggtaaccaaaaaaactttacaagtaaaattgaatcttttaaccccaacagtggatggacaaattcaaccacaagtgtggacatcagagggaaaccatgggggaattaaagtgaccccaattaaaatacagttaaagatccctggaaaagttgtctagagaaaacaataccctatttctctacaagaaggataggacttaaaccaattatagagggactacttcaagagggtctcttagaaccctgtatgtcttcctataatacccctactctccctttgcataaggtggatgggtcctatcgcttagtccaggatttgtggacaattaaccagattgttaagactaaacatccagtggccccaaatccttatatcctcctgagtaaaattacatttgaccaccaatggttcagtgtaattgacttaaaggatgccttttgggcatgcgccctggactcagacaattgggacctattcgcctttgaatgggaggacgcagtaactggaagaggaaaacagtatagatggacagtcttcccccaggggtttacagactccccacatcttttgaggcaaattttagaacaggtgttggaagactttacaccccctcatggggacatgtctactccaatatgtagatgacttattactctcaaacactgatcaaaagaagcttacagcagctacagtttccgttctcaattttcttggggaacaaggccttagggtctccaagaagaagttacaatttgttgaaaagttctgggagctgaggttcaagaagagaattttcaagaagagaatctgcctgatgacaaagtccaggggattctaaagaaaggcttcaaagcagcacatccaccagcacacagaaagcatgaggctgtaatgcctgagaaaacatgattctaaatctctgtccttcctgtttttaacaattactctgtgctctgtttaccaggcctaactcctcattccttgccttaaagaaaaaaattattgacttgttatctaaatcttgggagtcattcttgcttgctaaatgtttgggaaatcaactcttcattatccacacctaaattcaatgagtttttagaaagattacttttccttctaagagaatcatagatagcaatggtatttactacttgtagttttagaagaaattgttaagatttatagatgtagtttgaaacatttagagttaattagtttgaaaaattgtttttctttggctgatttattaatctataaaaagaaaataggcataaagatttattgctaattgttaaatataagttagtaaaacaggttgtggttgttgagttactaaccaagcacttgccctaaaaacacaatgcatttgtggtaatcacaaaggtcacaagaagtcttacatctctgacatttgtggccagtgtgatctattagtcctacctggttatcttttaatgggtttagagcatatcctgcctggacaattgctttttaatctttaaacttatttggcctcttactgcttctgcaagttatagtcttttctcctatttaagtcactgacatccaccaataaagttgagactgcatgaacactactcaagagtgtgcatctctgttatacctgagcctgccgtgcctcctcttgggaaattccctggctgctggagctggactctggcagaaaagggggtaaaatatttaggacatctaataagtgggaggtaaaagaaaactcaggccagaaaaaaatagagctgatcataggcctgcctctaccaactaccaaacacaaatttagaaaatttctaggcctgattggatattgccacctttggatcaattcgtatgcattaaaaactatattctaagcttgtggaggaaggccctgatcccttactatggagccacaaggaaatacaacatttcagggatctgagggaggtgctgatgggtgcccctgttctggctctaccatcctttgagaaaccttttcatttacttgtaagtgtggacaggggaatggctctaggtgtcctcacataggaacatgggggaagtcaccagccagtgacctttctttcctgcctcctggaccctgtcgccagaggatggcctgaatacatacaattggtagccacaactgccctcttaactgaagagagcaggaaactcagaaggctaaccatgagtaccccacaccaggtacaagccatcctaaaccaaagggtatggagatggctcactgactcctgaattttaaaatatgggcctatatcattggaaagggatgacttaattttaaccacagattaggacttaaatcctacttttttcctcactcaaaggtaacccttgacttccattgaacatcattgtttaaatttaatagactatcagatcaaaacttgacccaatctatggaaactctcttctgttcagggagatatttatccattgatggatcttgagtcatccaaggaaaacaacacaatggtcactcagtcattgatggagagactcaatcaatagctgagtcaggaagactcccaaatgcatagtcagctcaaacttgtgaactctttctccttaaccaatccttaaaatatttaaaaagaaaggaggacacaatctatactgactctaaatatgcctttggagtggtccatacccttagaaaaacttggatggagatgggacttattacagtaaaggacagggactaatacatgaagaattaattaaataagtacttaataatctccaactcgcagaagagataacagtggtatatgtaccaggccaccagaagggggcttcatttcaagcccaaggaaataccttagcagatgaggaagccaagaggttggcattagaattggagtttcctatcttccatcttacttcttcccttcccaaaataataatctctccctccttttcaaaaaaaagagaaggaacagctacatcagctggggacccaacctgacactcagggaagatggttctgctgggacagaaggaaatgctatccaaaccccttatgagagaaattctgacatacctacaccaagggatcctttgggggcctcaggccatgtgtaacacagttttaaggctctgtgggtgtgccagtatttacatgatagccaaacaggtaatagaaggtttcttaacatgcagtaagaccaataagaggactttaccaaaaacagctaccagaggaaggtctcctggtttaaggcctttccagagtatccaaattgattacactgaaatgcacaaaacagggtgacttaaatacctcttcgtcatagtagaccatctaactcattgtagaccatctaactctcatagtagaccatctaaccccattacccagtgccaatgccaattatgtgacaaaggccctattagagcaaattattccccaatttgtgatggttgaaaatatagatttgtataaagcaagtcattttacagctcagataataaagggactctccaaagaattagatattaaatggaaataccatattccatggcatcctccctcttctggtcaaattgagagaatgaactaaactctcaaaactcactcaaataaattaatactagaaacccagctaccctggaccaaacatctccctattgctttactcagaattagaactgctccccaaaaggatgttggtctatctccacaggaaatgttacatggactatcttacctaggaagatcatctgacctgcctacctttgaagccaaagatcaatttttaaggagttatgtatttggtttatcctcttctcttcactttctcagacagaagggattactagcccaggctccactgtttgatttccctgtccattaacatcagcctggagactatgtgttaatcaaatcatggaaagaagacaaactccagccaacctgggatggacctttcctggtgtttctgatcaccaaaactgcagtttgaatggctgagtgacgatggactcaccacacccaggtgaaaaaaggggggccatagcagataaagaaaaatggatggattctccgggaccactgaaacccagttagtcttaaaaagggcttaaaactattcctgatatgggtgactatttggggatcattattatttggtaatcagggtgaatcatgggaccctctaactccaatatattatcagggcctgggattatgggcaggttatccacacacattagttattaacttaacccagactcctaaccaaatagtcataaaatttgaggcccaagtggttccctttactctgggatggtcatcagacccacagagtcctgaatgtatgattgcccttttctaggacaaaacaggttggaataatgagtcctgttggaccttgtcactgctatttcctgaagccaaaagttccacagatcagcccctgaaaactgtttggccgccaagtaaaaacatcaatttctcctcctgtctagaatgacagggtgcagaggtgactttcttgggcaacctgacaaggtgcagtgaaaaccctacaacaccctccataataaatcccagttctgagtgccccaggaagatatctggtggtattgtggggggtccactaatgggcagtcttccagaaaattggagtggcacctgtgctttggtgcaattggccatccctttcaccttggcttttaggccccaatctcaaactcagcccacctgaaaggaatgagacaccactccagaggggtcctttgaccccctgatctgtgttgactcaataggtattccatggggtgttccaaatgaatttaaggcaagaaatcaaatagctgctgggtttaaatctgctctcttttggtggtcaaccataaataaaaacgttgattggataaactacatctattacaatcagcaaagatttgttaattacactagggatgccattaaaggaatagctgaacagctaggcccaactagttaaatggcatgggaaaataaacttgctttagacatgatgctggcagaaaatggtggactctgtgtaatgtttggtatccagtgctgtatattcattcccaataacaccaccccagacagcaccatcactaaggccctatgtggattaatggccttagcaaatgaactttcagggatttctggtattaatggccccttcacagaccttttagaaaactggtttggaaaatggaagatactaatagcttcaaactttacccctcaaattgctgtagttagtgtccttgtcttagttgcctgttgtataattccttgttccaggggacttattcaaagattaatagagattgccctaacaaagcaactgggacccctccccaccaagccagcatactcctgatggacacaatagagcatgagaaccaaactatgctcaaagagtttgaagaaaataatatttgattaaaaaaaatgaaaggggggaatcatggaaagtaacataatgtcttttctatcaaagtaaatctcagttaatccattttgatctggttttggctgaaatgtccccctgaaacctcttcctctttacctcttttcccagcagcaatttgtttcaattagccaactgggaagactgtgtgccctgatctgaccaatgggaaggagacaggtaaatcacctgcattagggataaataggggagggtcctttatttgatgcatgcacttattggagtacttgcacccttctgcagaagtaaagagccctgtcaagatttttccttgttcacatgtctcactttccaacactgatgacccgagccagagttatcttaatttcca

SEQ ID NO: 69 - DNA, 10433 bp, Artificial
  ss364 sequence
  misc_feature (2689)..(2788): n is a, c, g, or t
  misc_feature (2809)..(2809): n is a, c, g, or t
  misc_feature (2813)..(2813): n is a, c, g, or t
tgttgttttaactaaagaacaaccagcccttggctaagaaggcagctgcaaggcttttcagctgcactaatcactatgccacccttcttgtaataatgtaacaactgtgtgctttctgtccaagccagtagccctgctaattatgtacccagcattgctcatcagttctgcttctgtagccttgcttgctcagtttcttagggagaaacactgtctgcttggaatgggggaggtttgggatgcttacgtgggaaaatcaagaccttgtagtgtataaaggttactgagaacaaaacctggggctcagactctggaggtgactcctctgagcccgcaccggtgctgaataaaccttgcttttccatatctccgagtgctgtttgtctccttccgttgccactgtttttgcggtttccgcaacatttgtgtgcgttggccgggaagctgacaaccgagctggcctcttgtgccactgttgtcgggtaaccaggggaggccacggtcgccgtcccagtgacagctggatatcgcgcaccagccattttgccggatccagaccctcactcgggccgtggccttggcccacacctcttcccgaagggactcagaaggatagtggaaacaggttcctggacaggatgtcagttggagaatgccctggggacatctgcccaagtcaggaccagccatatggcggaagcagagactgatcacctttcagtgaccaaagggtcactcaggtcagggtttgctccttatgatccggaggcttgtcatttctggtgtgtgtgtgtgtgagtgactggagagaacaagagcccatgctccaccgtctttggactacagagccagagtgagtcctaacctgcagttccgcggcgacctcatatggcttatggtggccctctttggggggaacctgacgttggggtttatacagtcccacctatgctaagaggcacctgaaatatctcctccggaggagcggtcaggtggatgaagcgattgttacctgaggccttgccctcactgtttgtcttgcgtcactggcacagggtgggactttacacaatgggtaaatcggcttccaagcccactgtcttagagtatatgggtaagaattttaaaaaaggattttctagagattatggtgttaagctgagtcatggaaaactgtgtaccctctgtaccctagagtggctggccctcctttggtgttggctggcctccagaagggaccttagatgtgttcacaattacagcagtatataatgttataacaggagaccctggacacccagactaatttctgtatattgataaattgttggaaattgcctatttgaggcccccatgggttcggttctgcaccacagaccagggacagtgtaaggtgctagtagaccagtccaaagagaaaaccttttctcaaaaaaagtgccacctatttatcaagcagaacctgaggactcaccccctatgccaccaccttatctgctgctggccccacctccaggagccgaaggtccccagatgccagatagcccaccaccttctgtttctcttcctccgcttctgaagttcccgaggtgatatcacccccgcagacagattctccagaacctatgagcaggcgtctccattcagctcagggagcagccactccagcattacaaatgcccttatgggagacacggggaccacagcaagtcgcccccgatgggaccatacaagaggggggatgtttttattattaccagtccctttccactgccgatctcctcaactggaaacaccatactccctcatattctgaaaagcctcaggtgctgattgagctcttaaaattcattttccagacacactgtcccacctggatagactgccggcaactcctttttactctatttgacactgaagagcgctggcaaattgtaacagaagcccaaaaatggcttcaggccaatgcggggggtggagcagacttggcaaactgggtgagggaagccttcccagaagaaaacccccactgggactatggcactgaaaaagggaaacgtaacctagagaggtaccggcaggccttcctacagggggaaaaagctggggctaaaaagcccactagtatagctaagatcagtgaaatactacaagagccaaatgaaagcccagccaaattctatgagagactatgtgaggctttccaaacctacaccccttttaatcccgaggcccctgagaaccaacggatgataaatgctgcctttgtgggacaagcccaatcagatatctgtaaaaagctacagaaattagaaggctttgcaggagagaatgccactaaactgttggaaatagccaacagggtttttattaactgagaccaggtggctggccgtgatacagaaaagagaatgaaacaaaaagtgactcttctggcagccgccctgtcaaaaccggtgcccccagtgggaccaccccataggggacaagacacaaggccagggaaaaggagtcccctggaacatgaccaatgtgcttactgcaaagaaaagggacattggaaaaatgaatgccccaaccatcctgagaaaaagaccaaggccccacctagccagtaccgatctgagccattcagcaccaacctgatcggcctagctgagtctgattaggggggaccaggctctctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaaaattgcctatttgagncccncatgggttcggttctgcaccacagaccagggacagtgtaggtgctagtagaccagtccaaagagagaacctttctcaaaaaagtgccacctataatcagcagactgaggactcacccctatgccaccaccttatctgctgctggccccacctccaggagccgaagtccccagatgccagatagcccaccaccttctgtttctcttcctccgcttctgaagttcccgaggtgatatcacccccgcagacagattctccagaacctgtgagcaggcgtctccattcagctcagggagcagccactccagcattacaaatgcccttatgggagacacggggaccacagcaagtcgcccccgatgggaccatacaagaggggggatgtttttattattaccagtccctttccactgccgatctcctcaactggaaacaccatactcccttatattctgaaaagcctcaggtgctgattgagctcttaaaattcattttccagacacactgtcccacctggatagactgccggcaactcctttttactctatttgacactgaagagcgctggcaaattgtaacagaagcccaaaaatggcttcaggccaatgcggggggtggagcagacttggcaaactgggtgagggaagccttcccagaagaaaacccccactgggactatggcactgaaaaagggaaacgtaacctagagaggtaccggcaggccttcctacagggggaaaaagctggggctaaaaagcccactagtatagctaaggtcagtgaaatactacaagagccaaatgaaagcccagccaaattctatgagagactatgtgaggctttccaaacctacaccccttttaatcccaaggcccctgagaaccaacggatgataaatgctgcctttgtgggacaagcccaatcagatatctgtaaaaagctacagaaattagaaggctttgcaggagagaatgccactaaactgttggaaatagccaacagggtttttattaactgagaccaggtggctggccgtgatacagaaaagagaatgaaacaaaaagtgactcttctggcagccgccctgtcaaaaccggtgcccccagtgggaccaccccataggggacaagacacaaggccagggaaaaggagtcccctggaacatgaccaatgtgcttactgcaaagaaaagggacattggaaaaatgaatgccccaaccatcctgagaaaaagaccaaggccccacctagccagtaccgatctgagccattcagcaccaacctgatcggcctagctgagtctgattaggggggaccaggctctctccaactgggcccctgagagcctatggtcagaattcaagtagggggccaccccatagactttatggttgacacaggtgctgaactttgtgtggttacacaacctgtggctcccctcttggggaaaaaaccaccattgttggggctacaggtaaccaaacccacaggcccttctgtggtcctcgacgatgtcggttaggaggccgtaaagtaatacatgaatttctttacctaactgactgcccagtccccctgatgggaagagacctgctggctaaaatggggaccattccccagaactagaggctaaatacccattggttacccattggtttgggctgaaggaaacccaccaggactggcaaaatgccatgctcctgtcttaattgagctaaaacccggagctcaaccggtaaagctacggcaatactcaattcccagagaagcttgactgggaatccaggttcacctggataggctgcttcagcatggactgttaataaaatgtcagtccccttggcacacccctttactgcccgtgaaaaaaaccaggaacacaggactaccgcccagtacaggacttgagggccataaataaagcaacagtcacattacacccgtccgtccctaacccatataccctgctagggctgatcccctccactgctaagtggtttacttgcctggacttaaaagacgctttattctgcctccaggtggcacctgccagtcagcccttgtttgcttttgaatgggagaatccacatacagggacaaaggaacagctcactggactagactcccacaaggattcaaaaactctcccactctttttagcagcgccttagctgctgacctagctgaatttcctggacaaaaactgggctgtgttttgctacagtatgttgacgacctcttactagctgacaccacggaggctcagtgcctagagggaacaagagctctcctttcccaactgatggaggcagggtatcgggtatcaaagaaaaaggcacaaatctgcaaaaaacaagtcaagtatctgggcttcaacatcatgcagggccgacgaatgctggggactaaaagaaagcaggcagtttgtgccattcctgtccctaccacccgccggaaggttcgtgagttcctaggggcagcaggattctgccggatatggatccccgggttttcagacctggccaggcctctgtatgaggctctaaaaggggaaaaaaggctccccttaaatggggaccaagccaggagacagcgtttcagacaatcaaaactaaactcactgaggctccagccttgggacttcctgatgtaaccagagaatttaacctttttgttcatgagaaaaatgggatggctttgggagtcttaactcaagaatttgggccttggcagaggccagtggcatatctgtctaaacaaattgactcagttgctgccagatggcctccctgcctccaagcgctggcagctaccaccttgttggtaagagaggctgacaagttggccctgggacaaaacctcaatgttaaagtcccacactcagttgtaaccctaatggataccaaggtccaccattggctcacacatgcacgaatgactcaatatcaagggttactatgtgaaaatccacgggtaaaattggaggttgtacgaactctgaacccagctacttttctgccagatgaagtggggccccccagaccataactgcctggaggtactagatgaggtgttttccagcaggcctgacttgacttataaaccactccaaagtcctgacctggttttatatactgatggcagcagctttatgggggatgaaaaaaggatggcaggatatgctgtggtatctgacttaaaagtgatagaagcagaggtgcttcctcaaggctggtcagcacagagagcagaattatgggccttaatcagagtactggaactcagccaagaccagtgagttaatatctataccgactcacgatatgcctttacaactttacatgtccatggagccttatataaaaaaagagggcgcctcactgctgaaggagaaagaattaaaaaccaggctgaaatcttaaagctcctagaggcagtatgggaacctaaagaagctgcagttatccactgtaaaggccgccaaaagggggatgacccagtgacaaaaggaaaccgtagtgctgatgtagctgccagacagacagcttggggacaatagccagacaaacctaaggtcttgctggccccagaagtgccagctgtccccaaatattctccagaggaaaaaaaaaatggataagagagaaaggaggaactgaaactaaaacgggatagtgggtcacacgggaccactgagtttacattccagaacagctggcctacaaactagtccgccaagaacatgagctaacccacatgggcaaaactgccttagagatcctactgggctggtactatctcattgctcatcttcctgcactctgctcctctgtctcccaaagatgcataacctgtttacagaataatgcctgccaggggccccacagaccagctggggtgcaacactgcggactgtccccatttgaggatatggaaatagactttactgaggtcacccctagtaagggatacaaatatttactagtttttatctgtactttttcaggatgggtagaggccttccctacccgaactgaaaaggcaagggaagtaaccaaggcactcctgagagacattattcccagatatagaaagcctctgaccatcaggtaagataatggaccagcatttgtggccgaaacggtacaataggtgacaaaagcttacagatccgatggaaactacactctgcttatcgccctcaaagttcagggaaagtagaatgcatgaactgaacccttaaacagaccctggcaaagttatgtcaggaaactggcttgccctggatagacatgttgccggtggccctcttaaaagtgagatgctcaccctgagtgggaataggattcttgccatttaaaatcttatatagaaggccacctccactaatcagtttaaaaaaaaaaaaacactagggagttggaaaacttggaattacataatcaattacaaggactggggctcactatttctcagatatataaatgggtcacagacagactacctgtgtccttagatataacagtacaccctcacaagccaggggaccaggtgtggataaaggactgaaaaaaggagcctttgaggctggtatggaagggcccctatactgtaattctaaccacccccaccgctcttaaagtaacaggaataaatgcttagatccatcattctagagttaaaccggctggcatagctgacgaccatggagagtgggagactgccctcgatccggagagacctcttcgcctgacaatacagaggaggagacgacgatctcaaagccctgctctgaccacaccggaagctggtcagtcaacgcatggctgaagcttgaggaatcggctgcctgtgagcccaagtggaaggagggtttcaaaagaagcatttgcattgatgaaagaggccttgaccctggaactgtgctacatttccagagaatcacgtttggcctaagctgcctctcacagggtctttcattccttttataaagagataagaaacaccccacctcccaatctggccataactaagaacttgttcttagccctggcagaaactattgcacaaactctcaaagtctcctcttgttatgtgtgcggggaaatgaacacaggagaccactggccttggcaagccagagaaatggacccattagagcctaataatgaaactgcatacccccaactcactgatggggtatggctcctcaaaactcctattatagggaaaaattgtcttgcgaggcggggaggacggtttaatgtttcagttgggagcctaacatgtttagacctaaggtattataatctgactgcccaaaagactcaatggtggtcatcctccaattgctcagagcccaagcctaatcccttgtctaacttttccctccttcgacaagcatgggaagatatcagtactaatatccagtggtgggcaccaaagggattatattatatttgtgggaaaatggcctattccatactccccccacattgggctggggcatgtgtactgggaacaatgagaccttccttcttcctgcttccactgtcactaggggagcaactaggagttcctatgtatagggcacagggtgcccagagagaccggagggctctccaaattggagactgaaaagatgatgaatggcccccagaacggataattcaatattatggacctgccacctgggcagaggatggctcttggggatatcacacccctatctatatgctgaaccacatcttcagactacaggtagttttggaacttataacaaatgacactgaaacggccttgactatattggcccaacaacaaactaaaatgcacagtacaatctacaaaaatcgcttggccttggattatttacttgcttctaaaagaggggtgtgtggaaaatttaacttaagtaattgctgtctacaaatagatgacaccggaaaggtggtaaaagaaattgctgactgcatgactaaactagcccatgtacctgtacaaacttgaaaaggatgggatgcagacagtctctttggtaaatggttctcttggttgggaggaattaagacaatggtcggaatagtcatggttatactcgcagtgtgcctacttgttccctgccttgtacctctcctgataaatattataaaaagttttataaaaaccatggttaaaagaaaaacagcctcccacctgctacttattagaggctaccaaagggttatgactgatgatgacctgtaaagggtacagatgcaccctgaacatcaagaggggggaatgaaatggagttttaactaaagaacaaccagcccttggctaagaaggcagctgcaaggctttccagctgcactaatcactatgccacccttcttgtaataatgtaacaactgtgtgctctctgtccaagccagtagccctgctaattaggtacccatcattgctcatcagttctgcttctgtagccttgcttgctcagtttctaagggagaaacactgtctgcttgggaatgggggaggtttgggatgcttacatgggaaaatcaagaccttgtagtgtataaaggttactgagaacaaagacctggggctcagactctggaggtgactcctctgagcccgcaccggtgcggaataaaccttgcttttccatatctccgagtgctgtttgtctccttcctttgccacagtatttgtgatttcggcaacaatagagatgaagtcgttgtgcgttggctcacttaaaatgcttttctcccactgtggaagttgtctttgtgttttgctgctggcttcccgtgctgtgcaaaagcttgtaagttggactaggtccccttggtttatgttggctcttaggatatctgttgccataggagaatgatgtgcgcgaccattcctgaggttgacgggagcgaacgttttgcccatgttctcctccaggaggtggtatgtgtgtctctaaaggagcgatgtgtttctgtgtgtacacaggggaggtggagacttgcattgatgtgtcggcgaaatccgggctatggttatgtgtcagtcgatgcaggtgggtgagctggctcctcctctcatttggtcgatggacatcatttcccatgtggtttgctggagctatgtgcatgtgtcttccttgcacatccatgttggtatgtctctccccaggtgcctgactgaccacgtcttgttcgcatggcttggagttgttaggagcgtgccaagtatgcgtctctggaggaggctaaggtgttcctacatgcgtttgtaagtgggtactaagagatggtctgtctgtgtatattgaggggagggcagatgcatgcatgccttttgacacaggtacactcagagcgtcctttggtttctgtgttgggggaggagaagggtggttgtattttgaagaggtagcctcatgactagtgtttgaggaatcggtatggtccagggttgggaatgaattgtacgtgtgtgtccataggtgtgggagatgtgtatctgtgtcttaggcagcataggcgaattgtggctgtgtgtgccttggagttcctggagctcctgcagtgtgtattgtgagagaagtgagaagtccgtttgtgtgtttggaaagcca

SEQ ID NO: 70 - DNA, 2683 bp, Artificial
  ss505 sequence
  misc_feature (71)..(170): n is a, c, g, or t
cccctcaccggaaggagcaacctcacagtctcgcagtgctctgacagccccaggactttgacacgagtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagttcccgtcgtggcgcagtggttaacgaatccgactaggaaccatgaggttgtgggttcggtccctgcccttgctcagtgggttaacgatccggcgttgccgtgagctgtggtgtaggttgcagaagcggctcggatcctgcgttgctgtgcctctggcgtaggctggctacagctccgattcaacccctagcctgggaacctccatatgccgtgggagcggcccaagaaatagcaacaacaacaacaacaaaagacaaaaagacaaaagacccaaaaaaaaaaaaaaaaaaaaaaaaaaaatcccacaaggccccaaggaaccttatactgaatttctagctcgtttacaagaggcattaaaacgacaaattgctaactctgaagtgtctgatactatttttcaattgttatcatatgaaaatgcaaatactgactgcgaaaaggccacaggatttttaaaaggaaaagctaacattgctgaatatatcaaggcctgtcagggagtggggacggagtccattaaggcctcaatgctagcccaagccatggataatttaaaggttaaagataaattttcagaaaaatgttttaattgtggcaagacaggacatacttaaaaacaatggcgcgctcctccacgagtccgaccctcttttcacggagcttcggcaccttctaggaacaataataaacagcccagactgtgtctgagatgtaataaaggaaatcactgggtgagtcagtgccggtccatctttcataaagatggaaccccctttgtcaggaaaccctcctcggggcaagaagctctccctatccaaaacaagagccaaactcccaaccgatgcgagattccctgggactatgctctgcaggagatttcaacatcacagtagatctccctagtttacaggacttaattctccaccctagtgaaactcctacttctgttgcaaccaaactggaaaagccattaccaacagatacagtaggatggataacaggaagggcagggctgacagaagaaggagttcgagttcataccgggatattggataacataggggatggtttccactgcgattccttggaaagttaaaaaaggggatcagattgcccagatcttaattttacctagagtacaaataaataaataaataaataaataaagaggaataattttagacagaagggaattcaataccacaggaggggcaggagtgttttttatcagaaaaggtcctagaggaaagacccacttgtcaagttatcataaatgggaagtcttttagaggattgattgacactggcgctgatgtttcaatcattagccatttacattggccagacaacctggcctcttcagccagccgatattgaagtcactgggttaggaaaagcagagggtctcaaaaagggtgcccaagggcctaaatgtgaaggacccgatgggcagccagctagactgaaaccttatgttgctcaactccctatcaatctatgggggagagatttattacaacagtggcatgcagaaattgacataccaccagtagatcaatatagtcatcaaagccaaaaaatattacagaagcagggttacattcccggacgggggttagggcaacgtcatcagggcagagtggaacctgttgcatctgagggtaaaatggataaatctggtttgggacatcggccttttcattagtggccactgcttgtaaaaataattatgcttctcctaaacctattcgattacgatggactacggaaaaaccagtttgggctgagccgtggccgcttcagaaaaattaaaggttttaaatgatcttgtccaagaacaattagagtagggccatctagaagaatcctttcatccttgaaattcgccagtgtttgttatacaaaaaaaaatcaggaaaatggagattgtcaacagatttaagaggtgtaaatgctgtaattcagcctgtgggtgcccttcaaccaggcctcccatctcctagtaggacaccagctgactggctgttaattatcctggacttaaaagactgctttttcacaattcctttacacccagaagataggggaaaatctgccttttcagtgccagtgataaacagtatagcccctagaaagcattatcaatggaaggtcctgcctcaagatatgttaaacagccctaccttgggtcagtattatgcggcttcagttgctgagccagtccgacaacaatttcctaaatgctatattgttcattatatggatgatatactttgtgctgcaccctctcaggagcagctggctaaggtttttcaatgcttgcaatcctgtctaaagggagcaggattgattattgctcctgaaaagattccaatgaaaagtccatatcaatatctgggaactgcggttgaacataccactgttcaccctcaaaaggtagaattaagaagagatcaaatttctacattaaatgatttacaaaaactgttaggagatattaattgg

SEQ ID NO: 71 - DNA, 8215 bp, Artificial
  ss507 sequence
tggtgcgttggccgggaaatcctgcgaccaccccttacacccgagaaccgacttggaggtaaagggatcccctttggaacgtgtgtgtgtcggccggcgtctctgttctgagtgtctgttttcggtgatgcgcgctttctgtttgcagctgtcctctcagaccgtgaggactggaggactgtgatcagcagatgtgctaggaggatcacaggctgccgccctgggggacgccccgggaggtggggagagccagggatgcctggtggtctcctactgtcggtcggagttctgttgttgaggcgaaagcttccccctccgcggccgtccgactcttttgcctgcttgtggaagacacggacgggtcgcgtgtgtctggatctgttggtttctgttttgtgtgtctttgtcttgtgcatccttgtctacagggacagacggtgacgacccccccttagtttgactctcgatcattggactgaagttaaatccagggctcataatttgtcagttcaggttaagaagggaccttggcagactttctgtgcctctgaatggccgacattcgatgttggatggccatcagaggggacctttaattctgagattatcctggctgttaaagcaattatttttcagactggacccggctctcatcccgatcaggagccctatattcttacgtggcaagatttggcagaagatcctccgccatgggttaaaccctggctaaataaaccaagaaagccaggtccccgaattctggctcttggagagaaaaacaaacactcggccgaaaaagtcaagccctctcctcgtatctaccccgagattgaggagccgccgacttggccggaaccccaacccgttcccccacccccttatccagcacagggggctgcgaggggaccctctgcccctcctggagctccggcggcggagggacctgctgctgggactcggagccggaggggcgctaccccggagcggacagatgaggtcgtgacattactgctgcgcacctgtggccctcccatgccggggggccaactgcagcccctccagtattggcccttttcttctgcagatctctataattggaaaactaaccatccccctttctcggaggatccccaacgcctcacggggttggtggagtcccttatgttctctcaccagcccacttgggataattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccagttgggactacaacacggctgaaggtagggagagcttgaaaatctatcaccaggctctggtggcgggtctccggggcgcctcaagacggcccactaatttggctaaggtaagagaggtgatgcagggaccgaacgaacctccctcggtatttcttgagaggctcatggaagccttcaggcggttcaccccttttgatcctacctcggaggcccagaaagcctcagtggccctggccttcatagggcagtcggccctggacatcagaagaaaacttcagagactagaagggttacaggaggctgagttacgtgatctagtgaaggaggcagagaaagtgtattacaaaagggagacagaagaggaaagggaacaaaaaaaagaaagggagaaagagaaaagggaggaaagacgtgatagacggcaagagaagaatttgactaagatcttggccgcagtggttgaagggacgagcagtagagagagagagagagattttaggaaaattaggtcaggccctagacagtcagggaacctgggcaataggaccccactcgacaaggaccagtgcgtgtattgtaaagaaaaaggacactgggcaagggactgccccaagaagggaaacaaaggaccaaaggtcctagctctggaagaagataaagattaggggagacggggttcggaccccctccccgagcccagggtaactttgaaggtggaggggcaaccagttgagttcctggttgataccggagcggagcattcagtgctgctacagccattaggaaaactaaaagataaaaaatcctgggtgatgggtgccacagggcaacggcagtatccatggactacccgaagaaccgttgacttgggagtgggacgggtaacccacttgtttctggtcatccctgagtgcccaatacccctcctaggtagagacttactgaccaagatgggagctcaaatttcttttgaacaagggaaaccagaagtgtctgcgaataacaaacccatcactgtgttgaccctccaattagatgatgaatatcgactatattctcccctagtaaagcctgatcaaaatatatagtcctggttggagcagtttccccaagcctgggcagaaaccgcagggatgggtttggcaaagcaagttcccccacaggttattcagctgaaggccagtgccacaccaatatcagtcagacagtaccccttgagtagagaggctcgagaagaaatttggccgcatgttcaaagattaatccaacagggcatcctagttcctgtccgatccccttggaatactcccctgctaccagttaggaagcctgggaccaatgattaccgaccagtacaggacttgagagaggtcaataaacgggtgcaggacatacacccaatggtcccgaacccttataacctcttgagcgctctcccacccaaacggaactggtacacagtattggacttaaaaaatgccttcttctgcctgagattacaccccactagccaaccactttttgcctttgagtggagggatccaggtacgggaagaaccggacagctcacctggacccgactgccccaagggttcaaaaactccccgaccatctttgacgaagccctacacagagacctggccaacttcaggatccaacacccccaggtgaccctcctccagtacgtggatgactgcttctggcgggagccaccaaacaggactgcttagaaaggtacgaaggcactactactggaattgtctgacctaggctaccgagcctcagctaaaaaggcccagatttgcaggagagaggtaacatacttggggtacagtctacgggacgggcagcgatggctgacggaggcacggaagagaactgtagtccagatactggccccaaccacagccaagcaagtgagagagtttttggggacagctggattttgcagactgtggatcccgggctttgcgaccttagcagccccactctacccgctaaccaaagaaaaaggggaattctcctgggctcctgagcaccagaaggcatttgatgctatcaaaaaggccctgctgagcgcacctgccctggccctccctgatgtaactaaaccctttaccctttatgtggatgagcataagggggtagcccggggagttttaacccaatccctaggaccatggaggagacctgttgcctacctgtcaaagaagctcgatcctgtagccagtggttggcccgtatgcctgaaggctatcgcagctgtggccatactggtcaaggacgctgacaaattgactttgggacagaatataactgtaatagccccccatgcgttggagaacatcgtccggcagcccccagaccgatggatgaccaacgcccgcatgacccactatcaaagcctgcttctcacagaaaggatcacgttcgctccacccgccgctctcaaccctgccactcttctgcctgaagagaccgatgaaccagtgactcatgattgccatcaactgatgatcaaggagactggtcgtccgcaagataccttacagacataccgttgactggagaagtgatgacttgattcacagatggtagcggcaatatagatggaaggtaccatgatggctacggcgatgctggaggacgtgaacccacactatatgggccagccgcctgtaggatgacacttcaccacaactcattaaattcgtaactgctctcaaacctttgcggttggccgatgtaaacccctaatcatttatacgaacaggccgcatgcctttgcaagtgcccacgtgctggtggtcatctattaacaaagcgagatcgctcaacctccccagggatccctgtcaacaacaaatacaaaattctaaacttagttgaggccttacatttgccaaaaaaaggtagtccatatacattgccctggacaatacaacagccaataactggtctccacaagcaaaccaaatggctgagtgagccccgaccccgcactattccgccaatggcaccagccacctcccatccccccagcacttcaggcaccctctccgagtccttccacccgcacccgcccgcttcgggcaggagccctgcagacccaccctgtccaggttgagcctgaactccgaggaggtgccctcaccctgacagggcagcctctcaggccagcactgtgatccctgttctctcccaggattcccaggccccaaaccagccctcatctcttggatggaacaggagagtgaggcttggagccccgccgcccaggatcctgaggagggggaaagcctgggaggacctctgagaggtgagggatggtcccaggtctcccccgcctggcattccagggcttcctgtctagcaatgttttctttcagatcgccatctgcagcgtccctaaaggaaagaaagagccgaccgaagagccaactcttctttcctatagagaagggaagaaggcagacctggtacaaagtttgcagaacttgggacagtagccatgttgagaccagagtaagataatcaggagccccgggggagttctgtggtgcagcgggttaaggatccagcattgtcactgcagcagctcaggttgctgttgtggcttgggttctatccccagcctgggaacttcggccatgggtgaggaaaaaaaaaaaaaaaaaaggaaaagaaaaaaaaaaaatctggagcccaagtccatgattccctcttatagaaacactgctcattctccccttttctggaacaactaaaaccccctaagaatggaagcagcttcaggtctgcctttcacattcctcaagcaaggcaatgtggtgcaagagaaaatgcccaggaatagacaagttggttcttcacccccttattatccctcagcagaataatttttttttttttttttttttgccttttgaggactgcatctgaggcatattgaggttcccaggctagggattgactcggagctgtagctaccggcctccaccacagccacagcaatgcaggatccgagccacgtctgcaacctgcctcacagctcacgggaacgccttaacccacgaaggaacctgcatcctcatgggtctagtcagattcatttccgctgagccacgcctgggcctccaacagaacaatcttgagggaatatctttcctcctctataacatgtcttaactctacaaaaattgagaaaccgcaataacaattggcactgcttgttgagcatttgctaagtgtgtaacacgtctactcatttactcctctcaacagccctgcgaaataaggaaaccacgatgactctcatttgacatacaaggaaccaaggcccaaacaactcactttgaacaactttgatctgaaccctccttcaaagcctgggtattaaaccctgggcagaactttagcacttccctaagtaaaagcatcctacgtcctgagacaatataagccaatgtattttaacatgtaacttaattcctgttccctaggagatgccgcaaaccaaaaggaagatgaacccgaggcagggccaggagccaaaggacccagaaagacgtccggaaaggagaggcccgaagagctggttaaacacaccccggactcgaccatcagcaaaacctcgaccagagcacagacacccaggaacgctgcgcaggaccagagcacaggtgctcagcccccggtcccggtccccggcggccccggcggcggcgtggatgctcaggccagccagcggcgccacgtgtgcgcggactgcggccgccgcttcacctacccgtcgctgctggtcagccaccggcgcatgcactccggcgagcggcccttcccctgccccgagtgtggcatgcgcttcaagaggaagttcgccgtggaagcgcaccagtggatccaccgctcctgctctggcgggcggcggggccggaggcctgggatccgggctgtgcctcgggccccggtccgaggtgaccgggacccgccagtgctgttccgccactacccggacatcttcgaggagtgcggctgagcggctcccgcacgctgcccttgacggagcctgacctgggctctaaggactgactggtccctgagggaaactcctgtgtcaggacctaaaattcgtcccttgggcctcccccagggatccctcaagtttccaagcttgtaaaaagaaaagtgcctgtaaagattcaaatagattcaactcgacaccccctctccccagtctttctaaacaaatgaagggagtgagatgcttggacttttctcagcgttatctcagtagcaggggcaaccaagatcatgtgcaaacactgtctccaaaaatcagcccagcgcttatctgcagcagagggaaacgctgctgaggggacaaaggctggagaggaggccgcggatgcaaggcatggctaaaccccgcctaactgacagccccaggaagccctgccagtgacgtgggtgcaaagcatacagaaaccccagttgcggactcatctctgcaccttgcccccaaggcacagctggtaagtcacacaccctgcctgagcctcagctccctcctctgtaaaatgaagatcaataaaatctacctcaaagggttactgtgaagactgcaattgtaacaagattatgtatggcatagtaaatgtgcaataaacatttgttgaaagagtgaatgatgttggcattttacccctcagaacgtgaaaagataggttcccattgtggttcagcagtaggtaacgaacctgactggtatgactcatgaggatgcaggttccatccctggccctgctcggtgggttacatatccagtgttgccacgagctgcagtgtaggtcgcagaggtgactcgtggccgtggctgtggctggcagatgcagctccaattcaattcaacccctaggaagcagggatgaataccaatagctacattttacaaatgaataaactgaggctcaaggtttcactgctacaaggcagcagagctgcaaactggccctgtgcccacctgtatctaccacttacaagcactcagatctgggcccaacacaggtcaggggctcgggtgagggtgaagtgagaactcaggtctgggcggggagccagccttgcttgtctgggggagtctcggcaggaaaccgagagccctgccaaggccagtgactttcacttggaaaggacagtcagtgttcggtggccacatattgcctgacttctgttggagagacagccggtgataagggagctcagagacgagggaagctaatttcactcattccttaaataccattgaagactttgtggaggttttttgggtcggggagctgcagggacatactgactcaggtctagccttcaagagcgtgatttagggaattcccgttgtggctcagtaagttaagaagctgactagtatccatgaggatgtgggttcagtccctggccttgatcagtgggttaaagaatccagcattgccacaagctacggcgtaggtcgtggatgtggcctggatcctgtgttgctgtagctctaattcaacccctagcttgggaacttccatatgccacgggtgcggccctaagaagcccaaaaagaaggagttccgtcttgtcacagtggaaatgaatccaactaggaaccatgaggttgcaggttcgatccctggcctccctcagtgggttaaagatccggagttgccgtgagctatggtgtagttggcagacccgcctcggatctggcattgctgtgactgtgatgtaggctggcagcaacagctcgaattggacccctagcctgggaacctccatgtgccaagggtgtggccctaaaaagacaaaagagcaaaaagagaaagaaagaaggtg

SEQ ID NO: 72 - DNA, 10271 bp, Artificial
  ss524
tgcttctgtaagccccgcttgctcagcgcccccccatgatcatgtgaccactaacagacccacacctaaagctggaacattccctgccgccggctcctccagttcccactccggtccacccctccaagcgtggacccagaagaactggcctgtaaaagcctgtagcacccctgttcggggcctgggttctggagagcaatcttccccaggccggccgggtatgagagctaaattctcctcctctcccagtgtcgcttggtttctcgctggtcggtgctgcacgtggagctgtaacatttctggaggccccagcgagaccccaaccgttctggccctttgagccaccggggctgcggtgaagctgcaggaaggctggggagctccggaggcgaacgaggcggtgctccacccgacggtatttcgggtcctccttcgtggcggtgctccagtcctcccaatggccgaaccccaaccggactcggtggagagacggaccaactcccaagcaagactagttaaagctccggaataaggtaaggccccgaggccagtccccgtcaggtcctgcctactggcagaagaggagacctacgtcttccagtctgacgaccccaggaagggacctcccaagggggaggtctgtgacggctgagtgaatgcatgagtgactgtggcctgatacgattgcatctcaggttcagttgtgtggctccactgtttccactacggggtcccagtgggtcctaacctgcggttccatggtaacctcatacggtttacagctgcgtgggactctgaggattctctaacctccctgcgagttggatccaggttcggggtttatacgaaccagccaattgctaagaggcacctaaactccctagagagaggtggccaggcagacatctgaatgtgtgctccatgaaggggcatcccctccttgtcttgcttgccacagccttgcagggggaaacccaggtgggatattagcccttcgagaccaccctcacatgagtcgaagacccctttgccctcggcgattacaaaggagaggttcttcaaagaaatcttgaatttgaccttatccccagaaatccaggaatcttggcccgaatcctgggtggacctcgggattgttcattctgcctgctctcagaaccccaggagctgagtaaaggggatttttggttgcagccacactaggagatcccccttctagtccacctgctttgtcgtccacccaccatcctgagatcgtgttacgttagctccagattcagggaagactgcatccaaagacccttgagtttcattgaagccttagaatattcccaagaactcgccccaagggccaagacccggagtggttagcatccttagtggcaaagcaagtgcttgccccccggcacccctcccccgccatagagtgggcggagcgggggtcgctctgctttggggagtggaggaggcaacagtaaaagggacatccgccacggaaactgaagcaggctcctagctgtgggcagtagatcaggacctaacaccacgggggcacctaaatctaagcccacggcttaaactgcatgatcaagaatttcaagaagggcttttggggggactatggcgtcggaatgaaccctggacaacgccacaccccgtgtgagccaaagtggccctcctttggagtgggatggccttcagagggcacgccagacatgcccacaggaagggcggcctctcgggtggtcaccgacaccccaggacaccccgatcagttcccatacataggactttgcctccctgggtccggttctgcaccaatggccagggacaatgtaggatccttgtggcccaagcgccctcggaaaaaaaagaaggaccggctaaacctttcctacaaggagacccaggagacgacacccctccagccccgccgcctccgccctgtcttcccacggctccaccctttcttgtgcaaccaccaccccaacagttgccaaacagtccacctccctctgtgtctccaccagtcccacaaccgccatgggccccaagtccagcgccaaagggaagacgactccgctgggctcagcagtccgcacaaatgactgcagccttccaagctcccctgtgggagatgtggggcccccaacaagcaaatggtgatggcgctgggccctcccgttctctattaccagcccttcagcacaaccgaccccctgaactggaggcgcctcacccagctcactccgaaaatccatcttccaagcccaccagccaacctggggcgacacccgtcaactcctccctacctgcgccagcaccaaggaggggtctgcaagtggctccacggacagcctcctgcaggcacccttgaccttgaggggtgggcacagagggcagctccagaaaacagacctgactggggcttcaacactcaggccgggtgggcgccctggggtgccgtcggaatgctctccttcacggctgcgggccggagccaaaagccacccatgtgacaaagacgacgaccgtgctgatccagaaatccgacgagacaccgacggacttctacgagaggttgtgtgaggccttgcagaccttccctcccttggatcctgaggcacctgggcatcagcgaatggttaatgcagcctttgtggccccgtcttccagccacatgcttgtaagacacaagttggacggcttagctgggatgaacgcgtcacagttgctagaaacagcagggaaggtttttgtgagccaagatggcaagccctgcgggaagccggaaggcagatgaaacgaaaggtgtccctgagggcggccgcaccaggcaaccccgagcccagcaggtggcctcggccaccaggcagaagggagcaggaaggagccgcccttgagacgagggcaacgtgcatgttgtaaaggagatgggacactggaaaagcaaacgcccgcagcaaaaggggggccccctgagaaaaggagcctcgtccagtggaggaaggtgctgagcagaaccgattgggcacggcctcagcggcctgggctggaaccaagtccgcgcacaatccgtctttgccttcagtttatctccagtgtcttgcatcatcttcagcatcaacagtctcaagtctttttcctggaggctgagaatctcctgatcacttaactgattttctgggggtttttcctttctccctcgtctgagttatagttctctgtcttctcatttctataggtttttggtgtgacctttttacagataatagagttgttgcctctcttgcttctggcatctgtcccccttgtgggggcctgctgcaggcttcctgatggaagggacctggaacagtcagatcaggggaccctggactccttgctcctgggtccctgggagcccgcggttgaagtgatgacgggggaccaaccggtgacattcatggtggacactggtgctggacactcagtagtgaccaaaccgtggctcctcttactcagtgacaaacgaccattgttggggccactggaatgcaggccgcttgcccgttttgtgggcccagacctgccagctggggggccacccagtgactcccgagttcctgtgcataccgagtgccccatcccctcctgggaagagattgcctgaccaaactgggggcccagataacacttgcccctgggaagccggtgagtctcatgctgggcaaagagggggccctgccgatggcagtaactctaccacgcggggacagatggcgactctattgctcaaaggaaagcgggataagtcccacggccctcctgggagaattccccctgctctgggccgagaaagggccccctgcgatggccaagaatcatgcgctcgttgtggtggacttaaagcctggcaccacccccagcaaacagcaacagtaccctctaacacgagaggcacatccgggatccaagaacacattcggtgattgcgagacgccggaatcctggtagagtgccagtctccatggaatccctcctcctacctgtcaagatggccaaagggtatgattaccgaccagtgcgggacttgggcccggttagcctgcagccatcaccacccacccgtggtgccaaacccctgtcctctcttggggctgctgcccgctcaagcaagctggttcacctgcctagaccgcaaggatgccttcttctgccttggactagcacctgtcaggcagccactgtctgccttcgaaagggaggctccccagacaggtagaaaggtccaactaaccggacacggctaccacagggcttcaaaaattcacccactctgtctggggaagcaccagcccgagatctagctgcctttcccagcggggccatgaactgtaccctcgtctagtgtgtcatggatctgctactggcaagcattccccagaaggattgctgggaggaaacacgaaccctgctagctctgccgtctaccacaggcgaggaggcgtcctggaaaaaggcacagacctgcagacagacagttaagtacctcgggttcatcacctcaaaaggacatcgagccctcgggcgagagggcaaacaaaccaccggctccgtgcctccaccgtctaccgagggagaggtcagagaactcctcggggccgcgagattctgccggatttggacccccaggttccctagcagagctaagccgctgtgtgaggctgccgcaggctcgggtgaggaacccttgaggtggaacaaggagcaggaagaggcctccgaggaggtggaggggctgccagatgtaacacgggagttcagtttgttcatccatgagaaacaccgcactgcacggggtgctcacacagactctggggccacggcaacggccagtggcacatctgtccaagggttggatccagtggcgtcaggatggccaccctgcttgcgggcgctggcagccacagtggctctggcaagggaggtggccaagctcaccctgggacaaaacagtgatgtcccagcgaggtcccacactccgtcaccgctctgatgaacagccaaggacacacgtgggtgacccacttgagaaatacagccagggcctactctgtgaaaacctcagggtccccttggaaacagaacggacaataaagtcagctttccttctgcgcgccaagcccggccaaccccatcatgactgcgaagagataatggacaaagtctactcacgccgaccagactggaccgaagatgccccaacctggaactgttcacggatggaaggagcttcattcaggagggacgatggagagcaggctaggccgtgacgacgctgacagcagcacagaggcgaagccctcgccccaaggtcggtcagcagagagcaggaccgtgggcgtgtccaggcattggggtgtgtgcgcggggaaagccaacctgcatctacaccgactccaggtgtgccttcgctacctggcacgtacacggggctgcctccaaagaaaggggactgctgacagctggggagaggaaattaaagccaggaatccatcctccagttactggaggcgggctgggaccttcacaggtggctgtcctacactgttggggaccccagagaggggctgatcctgtcaggagaggaaactgactggccgaccaggctgccagagcagccgcccattgacccagcctcccgcttggacccaaacctccaaagtcctgctagccccagagctgcccacttccccaaaatatcaccaggaggaggaccactgggccccaaatgaaggggggattcaggcaaaggaaggctggggaaaactgccagaccagcgactcttcgctcccagctcaggggcaacacagatggtgacccaggaccatgaggcgacccacctgggaaagacagccctggaagggctgccgagccgatgcacctttatccccggactccctgcactctgtgctcaaatcagccacaggcgtaccacttgcgcccaaaacaacacaagtcaaggacccaggcttaacccaggaacacaagccagaggtacggcaccctctgaagacccagagaggtggacttcacccaggtcagcactgccggggctacgggtacgtacttgtgccggttggcatctactcaggatgggtggcagccgtccccactccgaccgagggagtcagggccctgaggcgagaaacaaaccctagatacggaccgcccctccccgttggatccaacattggacctgcctttgtggcagaagtggcccgaatccaaacaaagaccttgggggtaaggtggaaactccatgtcacatacagagcacagagtcgagggaaagtggagcaaaggaaccggaccctcgagacccgagccacgctccaccaggagatgcgactgccctgcatagacgtgttgttccgagcccgaggcagcccgagaccctttgttattccccgttagagatcctgtatgggaggcctcccctggtcattaagagggggtctccagcagatagggggtctggaaccgacccggcacagccacagcttgggaagggtactcggacacatccctggagaaaccctagagagagcacccaccctgtaggaaacggggtgtgtcctcagcagccccgggcagtggggtgggtcaaagactgcaagacagagctgctccagccagtctggacaggcgcccacatggcgatttgggcacctccacctgccaccaaaggtgcaggcctcaccccgtgggtccatcacagcagagtcaagggggctgcacccacggccgacacagacatctgggtgaccgcccggccccccgaggatcccctcaagatcgagttccagaggtacccgtcaccgtcaccagagaacgtccaccctgctctggccacccccggaagctggtcagtctgtgtgcggtggaagcttgagaactttccacgcgggacccgaaggagacccgtgctccggtggggaacgctaaccactggggtacctcaccctcctgctcaggggtgggctttatgctgtaaccctcacgatggggccatggtccccggccactcctctgtgggcgtatttcctgtctgcaggtctgttgggaactgtcctccttgtgggccaaaaggagtaacgagtgtggggacagttctgtggatggccgcccttctggtcatcgccagccacgggaaggccgctcgtccttggcgggccgtagtttcccaaatggcagccttggcaaacgagccggggtgctgggcctgcctatcagaagaccaagggtggagttcccatcgtggcgcagtggttaatgaatccaacgaggaaccatgaggtggcgggtttgatccctggccttgctccgtgggttgaggatccggtgttgccgtgagctgtggtgtaggttgcagatgcagctcggatctcgcgtggctgtggctgtggtgcaggcaggtggctacaggtccgatgagacccctcgcctgggaacctccacatgctgcgggagcaacccaagaaaaggcaaaaaaaaagaaaaaaaaagatgaccaagtatagtatatccactgcccccctccaggcgcaccggcctcgctgggagatatgaggtccctaagcccatccgtgagcggattctcggtgaccttccgcaatgagaccaagagcacgggagctggaagagcccctcccgccccgggatgaccgaggaagcaggtccgcagacacagggacgtgttagggttttgccaccagagtgatggggaagctgcctgtgtgttttcagcacctggaggccaaaggaggggaagggaggcttccgaaaacggcagtttctacagcgaacccgggtgggcgtcttggaatggagatggcggcacgatgtctgttaccaggggagagatggcgaaggcgaaggtgccagttcacgcggggcggcagcacccagaatgcaaccaaacggccggacgaggctttccggccccaggcagtgcaaagacagggaccagccaggaggtcacggcgccggccgacaaacagggtccctccgacccccaagcgcaagtgatacagaccacgcccaacaccacgcggtcacacagctcatattccggaatccggtttgccaaaacctcctccatgcacacaagcagatggatccccagtacagcccactctgtgtagacaagtacgtctcagggtgaaggccacagagcctaaagtgggatgaaccttgggacccgttcatccacccaagagatgtgctcatatcacattcaagagcacgggtgcgagggtccacaaccggggtgtcttaaagggaacgggattctgtctcctctgcgggaacaggctgtaggagagcttaccccgcaggtggaggggaagatgcagcatagttttcgccctgccagagttacaacttaaaagtccaacacaaatggtggcctcaggaagcattggttttttgggttttttgtctttctatcttttagggctgcacccgcagcgtatggaggttcccaggctggggtccattcggagctgtaactgctggcctacgccacagccacagccacagccacagccatgtgggttctgagtcgcgtctgcaacctacaccacagctcacggcaacgccagatccttaacccactgagtgatgccagggatggaacccacaacctcatggatgctagccgggttcattaactgctgagccatgacgggaactccaggaagcattcttaatttgggatccttcttggagtgggctcattcttccccagccagtgcaaacccctgaaataaaaggtcctacctggctggagatgaatggacacagtggagggggacacggtcacggcagcaccttctagaaagcccaggggcaggacattctttttttttcttttttcttcttttctttctttttttttttttttttttgtctttttgccttttctaggctgttcccatggcatatggaggttcccaggctaggggtctaattggagctgtagccactggcctacaccacagccacagcaacgcgggatccgagccatgtctgcgacctacaccacagctcacggcaacgccggatccttaacccactgagcgaggcccgggatcgaagctgcaacctcctggttccgcatcggattcgtcaaccactgagccacgacgggaactctgatgttccatctttagaggatgatttcggtttgctggaaaacccctgttagaaagatctgtgcttaacgtgactataatgcctcaagaatcgtggaaggccactgtagtggccatagaagcccaacaacaaggactcgactccttggcacagtggtgttacagaacggacgagggctggatggccttactgcccagcaagggggactctgtgctgtgttaaatgaatccttctgcttttatataaatgcaacatcgcaggtagaagaaaatctgactaccctcagaaacaaattaaaataatagataacataaaacacaaataggaggagctcccgctgtggctcagcagttagcaaacccgactagcatccacgaggacgtgggtttgatccctggcttcactcagtgggttgaggatccggcggtgccatgagctgtggtgtaggtggcagacgtggcttggatcccgtgtggctgtggctctggtggaggccagtagctatagctccaattagacccctggcctgggaacctccatatgctgtgggcgtggccctaaaatgaaaagacaaaaaaaaaaagaaagaaaaaacccaacacaaataggaaagggaggttggttggggctttactgtctgcatttgggtccctctggaccagggtcctgcccatagtaggaccgtcatgatggccccgttggccctgctgttcggaccctgtgttgccggtgcagccgcggggtggccaccgcacgtgcagagacagtgaggctgcagacgacgggccgggatcgctgcgtcccccgagccccacagactcaggtcactatagtcccttaaacgcagcaggtgcaggggaatctcccaaaagacctatgctcattcccaggttgaaaaaacatcaaaagcggggaatgtaagggaaaacctgacattactaatggaaaacctctccaactgcaagttctgcttctgtaagccccgcttgctcagcgcccccccatgatcatgtgaccactaacagacccacacctaaagctggaacattccctgccgccggctcctcca

SEQ ID NO: 73 - DNA, 5371 bp, Artificial
  ss525 sequence
  misc_feature (611)..(710): n is a, c, g, or t
  misc_feature (3152)..(3251): n is a, c, g, or t
ggactggggcgcgtattaccgacatcctccagggtgttttgggtacttctggctgctgccgtgcttcatgagtgtctacctcgccaactttggaatgaggtcatttctccttcatagggcatttttagtaacctcatgtccacttctgtgcgtattacatgtcatttctctaaaatgtttatttagttgtttcttactctgagatcagttcatgataactacatataaatgacatgatttcttctctccttatacaggccccttatacaccttttcttactgaattgatgtaccagaatctaaagatgctgattgaccctgtttctgtccgggacaaggacacactgagtatccactatctcatgctgccccatgttcggtaacaatcatatatatgccttgcctaagccatgggaaggagtgttgccagagatgcacggatgtaggggccccagttccctgctccagcccctccatgccctgctttccacctgagctgccgcttaggctacaaaatgggtagagggatgcttcgtgtggaatccctgttagagctgtggcaggtaggatgtgggattgatctcggacatgctagacaccaggaagtaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgactatacccggagctcaccggtaaagctatggcaatactcaattcccagagaagctcgactgggaatccaggttcacctggatcagctgcttcagcatggactgttaataaaatgtcagtccccttggaacacctctttactgccagtgaaaaaaccgggaacacaggactaccacccagtacaggacttgagagacataaataaagcaacagtcacattacacccttccatccctaacccatataccctgctagggctgatcccctccactgctaagtggtttacttgcctggacttaaaagacgctttattctgcctccgggtggcacctgccagtcagcccttgtttgcttttgaatgggaaaatccacacacagggacaaaggaacagctcacctggactagactcccacaaggattcaaaaactctcccactctttttagcggtgccttagctgctgacctggctgaatttcctggacaaaaactgggctgtgttttgctacagtatgttgacgacctcttactagctggcaccacagaggctcagtgcctagagggaacaagagctctcctttccctactgagggaggcaggttatcaggtatcaaagaaaaaggcacaaatctgcaaaaaacaagtcaagtatctgggcttcaacatcatgcaggaccaaagaatgctggggactgaaagaaagcaggcagtttgtgccattcctgtccctacaacctgccggaaggttcgtgagttcctaggggcagcaggattctgccggatatggatccccgggttttcagacctggccaggcctctgtatgaggctctaaaaggaaaaaaaaaaggctccccttaaatggggaccaagccaggagacagcgtttcagacaatcaaaactaaactcactgaggctccagccttggaacttcctgatataaccagagaatttaacctttttgttcatgaaaaaaatgggatggctttgggagtcttaactcaagaatttgggccttggcagaggccagtggcatatctgtctaaacaaattgactcagttgctgccggatggcctccctgcctccgagagctggcagctaccaccttgttggtaagagaggctgacaagttgaccctgggacaaaacctcaatgttaaagtcccacactcagttgtaaccctaatggataccaggggccaccattggctcacacatgcacgaatgactcaatatcaagggttactatgtaaaaatccacgggtaaaactggaggttgtatgaactctgaacccagccacttttctgccagatgaagcggggcccccagaccataactgcctggaggtactagatgagatattttccagcaggcctgacttgactgataaaccagtccaaaatcctgacttggttttatatactgatggcagcagctttatggaggatggaaaaaggatggcaggatatgctgtggtatctgacttaaaagtgatagaagcagaggtgcttcctcaaggctggtcagcacagagaacagaattatgggccttaatcagaacactggaactcagccaagaccagcgagttaatatctataccgactcacgatatgcctttgcaactttacatgtccctggagccttatataaaaaaagagggcacctcactgctaaaggaaaaggaattaaaaaccaggctaaaatcttaaagctcctagagacagtatgggaacctaaagaagttgtaaaggccactgtaaaggccaccaaaagagggatgacccagtgacaaaagaaaaccatagtgctgatgcagctgccagacaggcagcccgggaacaacagccagacaaacctaaggtcttgctggccccagaagtgccagctgtccccaaatattctccggaagaaaaaaaatggataaaggaaaaaggaaaaactaaaactaaagcggggtggtgggtcacacgggaccaccgagtttacattccagaacagctggcctacaaactagtctgccaagaacatgaactaacccacatgggcaaaactgccttagagaacttactgggccggtattatctcattgctcttcttcctgcactctgctcctctgtctcccaaagatacataacctgtttacagaataatgcccaccaggggccccacagaccagctggggcacagcactgtggactgtccccatttgaagatatgaaagtggactttactgaggtcacccctagtaaggcgtacaaatatttactagtttttatctatactttttcaggatgggtagatgccttccctacctgaactgaaaagacaagggaagtaaccaagacactcctgagagacattatttccagatatggaaggcctctgaccatcggtcagataatggaccacatttgtgccaaacagtacaacaggggcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtcaacgcatgctgaagctgaggaatcagcagcctggtaaaataaactgccttacctctcttccacaagagactctctaactgtcatatactgttatcttatgaccaacatgtatgtttgctgcctgttgctgttaatctggtcccctttggttctgtcaggatccacgtcctcatgtgacccgtgcattcaagcgactcgatcagatcaaggggttacatggactttgctttactccactcatttctcctgttccggagaaattcatggaagttgtactcacaacaggaccacttattctatctgtcaacaggggggccaatatacttgctttgatccacgatactcaccaaccgaggaatggttaaaagtccagcgctctcataaatcagggcagctaattaatcggacccaaattaccaaccccaagtggccagtgtcaatacttttcaatgcctatgaagctatgaatgggtcatggacttctactagaccatgtggaagcacatcatgaaaaagaaaatataggctccaacataaatatatgtgctgggggaccacctggaatgattgcctggaatgcacttactggagctgtgtggcctgggcaacctggaataagggagacaaaacagctgtccttcaaaagggtacagcccctccagactgccagactaaaacttgtaacccagttaatttcactattttcaattccagtgagcccaaatggaaacagggtttcaaaataagcattcgcattgacagaagaggccttgaccctggagctgtgctacatttccagaaaatcacgtttgcactccaagctgcctctcacagcgtctttcattccttttatgaagagataagaaacaccccacctcccattccggccacaactaagaacttgtttttagccctggcagaaactattgcacaaactctcaaggtctcctcttgttatgtatgcggggaaacaaacacaggagaccactggccttggtaagccagagaactggacccattagagcctcataatgagactgcatacccccaactcaccaatggggtatggctcctcagaactgctattatagggagaaattgtcttgcgagcggggaggacggtttaatgttttggtaaaaagcttaacatgtttaggcctgaggtgttataatctgactgcccaaaagactcaatggtggtcatcctccaatcgctcagagcccaagcctaatcccttgtctaacttttcacacctttgacaagcatgggaagatatcagtactaatatccagtggcagacaccaaagggattatattggatttgtggaaaaatggcctattccatactcccctaaaattgggctgggacatgtgtactgggaacaatcagaccttccttcctcctgctcccactgtcactaggggaacaactgggagttcctatatatagggcacagggtgcccagagacaccggagggctcttcaaattggagactggaaagatgatgaatggcccccagaatggataattcaatattatggacctgccaccttggcaaaggatggctcttggggatatcacacccctgtctatatgctgaaccacatcatcagactacagacggttttggaacttataaaaaatgacattgcaagggccttgactatattggcgcaacaacaaactaaaatgcgcagtgcaatctaccaaaatcgcttggccttggattatttacttgcttctgaaggaggggtttgtggaaaatttaacttaagtaatttgatgtctacaaatagatgacactggaaaggtggtagaagaaattgctgaccgcgtgactaaactacccatgtacctgtacaaacttggaaaggatgggatgcagacagtctctttggtaaatggttctcttggttgggaggaattaagacaatggtcagaatagtcattatactcgcagggtgcctacttgttccctgccttgtacctatgtttgaaagaaaaacagcctccccaccggctacgtattagaggcttccaaagggtaatgactgatgatgatttgtaaagggtgcagatgcaccctgaacatcaagaggggggaatgaaatg

SEQ ID NO: 74 - DNA, 8246 bp, Artificial
  ss535 sequence
tgattggtccacggagcgcgggctctcgatattttaaaatgattggtccacggagcgcgggctctcgatattttaaaatgattggtttgtgacgcacaggctttgttgtgaaccccataaaagctgtcccgattccgcactcggggccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgaggggattgtcttttactggcctttcatttggtgcgttggccgggaaaccctgcgaccaccccttacacccgagaaccgacttggaggtaaagggatcccctttggaacgtgtgtgtgtcggccggcgtctctgttctgagtgtctgttttcggtgatgcgcgctttcggtttgcagctgtcctctcagaccgtaaggactggaggactgtgatcagcagacgtgctaggaggatcacaggctgccaccctgggggacgccccgggaggtggggagagccagggacgcctggtggtctcctactgtcggtcagaggaccgagttctgttgttgaagcgaaagcttccccctccgcggccgtccgactcttttgcctgcttgtggaagacgcggacgggtcgcgtgtgtctggatctgttggtttctgtttcgtgtgtctttgtcttgtgcgtccttgtctacagttttaatatgggacagacagtgacgaccccccttagtttgactctcgaccattggactgaagttagatccagggctcataatttgtcagttcaggttaagaagggaccttggcagactttctgtgcctctgaatggccaacattcgatgttggatggccatcagaggggacctttaattctgaaattatcctggctgttaaggcaatcatttttcagactggacccagctctcatcctgatcaggagccctatatccttacgtggcaagatttggcagaagatcctccgccatgggttaaaccatggctaaataaaccaagaaagccaggtccccgaatcctggctcttggagagaaaaacaaacactcggccgaaaaagtcgagccctctcctcgtatctaccccgagatcgaggagccgccgacttggccggaaccccaacctgttcccccacccccttatccagcacagggtgctgtgaggggaccctctgcccctcctggagctccggtggtggagggacctgctgccgggactcggagccggagaggcgccaccccggagcggacagacgagatcgcgatattaccgctgcgcacctatggccctcccatgccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaatttggctaaggtaagagaggtgatgcagggaccgaacgaacctccctcggtatttcttgagaggctcatggaagccttcaggcggttcaccccttttgatcctacctcggaggcccagaaagcctcagtggccctggccttcattgggcagtcggctctggatatcagaaagaaacttcagagactggaagggttacaggaggctgagttacgtgatctagtgagagaggcagagaaggtgtattacagaagggagacagaagaggagaaggaacagagaaaagaaaaggagagagaagaaagggaggaaagacgtgatagacggcaagagaagaatttgactaagatcttggccgcagtggttgaagggaagagcagcagggagagagagagagattttaggaaaattaggtcaggccctagacagtcagggaacctgggcaataggaccccactcgacaaggaccagtgtgcgtattgtaaagaaaaaggacactgggcaaggaactgccccaagaagggaaacaaaggaccgaaggtcctagctctagaagaagataaagattaggggagacggggttcggaccccctccccgagcccagggtaactttgaaggtggaggggcaaccagttgagttcctggttgataccggagcggagcattcagtgctgctacaaccattaggaaaactaaaagaaaaaaaatcctgggtgatgggtgccacagggcaacggcagtatccatggactacccgaagaaccgttgacttggcagtgggatgggtaacccactcgtttctggtcatccctgagtgcccagtaccccttctaggtagagacttactgaccaagatgagagctcaaatttcttttgaacaaggaagaccagaagtgtctgtgaataacaaacccatcactgtgttgaccctccaattagatgatgaatatcgactatattctccccaagtaaagcctgatcaagatatacagtcctggttggagcagtttccccaagcctgggcagaaaccacagggatgggtttggcaaagcaagttcccccacaggttattcaactgaaggccagtgctacaccagtatcagtcagacagtaccccttgagtagagaggctcgagaaggaatttggccgcatgttcaaagattaatccaacagggcatcctagttcctgtccaatccccttggaatactcccctgctaccggttaggaagcctgggaccaatgattatcgaccagtacaggacttgagagaggtcaataaaagggtgcaggacatacacccaacggtcccgaacccttataacctcttgagcgccctcccgcctgaacggaactggtacacagtattggacttaaaagatgccttcttctgcctgagattacaccccactagccaaccgctttttgccttcgaatggagagatccaggtacgggaagaaccgggcagctcacctggacccgactgccccaagggttcaagaactccccgaccatctttgacgaagccctacacagggacctggccaacttcaggatccaacaccctcaggtgaccctcctccagtacgtggatgacctgcttctggcgggagccaccaaacaggactgcttagaaggtacgaaggcactactgctgaaattgtctgacctaggctacagagcctctgctaagaaggcccagatttgcaggagagaggtaacatacttggggtacagtttgcggggcgggcagcgatggctgacggaggcacggaagaaaactgtagtccagataccggccccaaccacagccaaacaagtgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccgaggagttttaacccaaaccctaggaccatggaggagacctgttgcctacctgtcaaagaagcttgatcctgtagccagtggttggcccgtatgcctgaaggctatcgcagctgtggccatactggtcaaggacgctgacaaattgactttgggacagaatataactgtaatagccccccatgcattggagaacatcgttcggcagcccccagaccgatggatgaccaatgcccgcatgacccactatcaaagcctgcttctcacagagagggtcactttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaggatggctgggacggcggtggtggacgggacccacacgatctgggccagcagcctgccggaaggaacttcagcgcaaaaggctgagctcatggccctcacgcaagctttgcggctggccgaagggaaatccataaacatttatacggacagcaggtatgcctttgcgactgcacacgtacacggggccatctataaacaaagggggttgcttacctcagcagggagggaaataaagaacaaagaggaaattctaagcctattagaagccttacatttgccaaaaaggctagctattatacactgtcctggacatcagaaagccaaagatctcatatctagagggaaccagatggctgaccgggttgccaagcaggcagcccaggctgttaaccttctgcctataatagaaacgcccaaagccccagaacccagacgacagtacaccctagaagactggcaagagataaaaaagatagaccagttctctgagactccggaggggacctgctatacctcatatgagaaggaaatcctgccccacaaagaagggttagaatatgtccaacagatacatcgtctcacccacctaggaactaaacacctgcagcagttggtcagaacatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaaaaaaatactggaggaaatttttccgagatttggaatacctaaggtaatcgggtcagacaatggtccagcttttgttgcccaggtaagtcagggactggccaagatattggggattgattgaaaactgcattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccctatgaattgctctacgggggaccccccccgttggtagaaattgcttctgtacatagtgctgatgtgctgctttcccagcctttgttctctaggctcaaggcgctcgagtgggtgaggcaacgagcgtggaagcagctccgggaggcctactcaggagaaggagacttgcaagttccacatcgcttccaagtgggagattcagtctatgttagacgccaccgtgcaggaaacctcgagactcggtggaagggcccttatctcgtacttttgaccacaccaacggctgtgaaagtcgaaggaatctccacctggatccatgcatcccacgttaagctggcgccacctcccgactcggggtggagagccgaaaagactgagaatccccttaagcttcgcctccatcgcctggttccttactctaacaataactccccaggccagtagtaaacgccttatagacagctcgaacccccatagacctttatcccttacctggctgattattgaccctgatacgggtgtcactgtaaatagcactcgaggtgttgctcctagaggcacctggtggcctgaactgcatttctgcctccgattgattaaccccgctgttaaaagcacacctcccaacctagtccgtagttatgggttctattgctgcccaggcacagagaaagagaaatactgtgggggttctggggaatccttctgtaggagatggagctgtgtcacctccaacgatggagactggaaatggccgatctctctccaggaccgggtaaaattctcctttgtcaattccggcccgggcaagtacaaagtgatgaaactatataaagataagagctgctccccatcagacttagattatctaaagataagtttcactgaaaaaagaaaacaggaaaatattcaaaagtggataaatggtatgagctggggaatagttttttataaatatggcgggggagcagggtccactttaaccattcgccttaggatagagacggggacagaaccccctgtggcagtgggacccgataaagtactggctgaacaggggcccccggccctggagccaccgcataacttgccggtgccccaattaacctcgctgcggcctgacataacacagccgcctagcaacggtaccactggattgattcctaccaacacgcctagaaactccccaggtgttcctgttaagacaggacagagactcttcagtctcatccagggagctttccaagccatcaactccaccgaccctgatgccacttcttcttgttggctttgtctatcctcagggcctccttattatgaggggatggctaaagaaggaaaattcaatgtgaccaaagagcatagaaatcaatgtacatgggggtcccaaaataagcttaccctcactgaagtttccgggaaggggacatgcataggaaaagctcccccatcccaccaacacctttgctatagtactgtggtttatgagcaggcctcagaaaatcagtatttagtacctggttataacaggtggtgggcatgcaatactgggttaaccccctgtgtttccacctcagtcttcaaccaatccaaaaatttctgtgtcatggtccaaatcgtcccccgagtgtactaccatcctgagaaagtggtccttgatgaatatgactatcggtataaccgaccaaaaagagaacccgtatcccttaccctagctgtaatgctcggattagggacggccgttggcgtaggaacagggacagctgccctgatcacaggaccacagcagctagagaaaggacttggtgaactacatgcggccatgacagaagatctccgagccttagaggagtctgttagcaacctagaagagtccctgacttctttgtctgaagtggttctacagaaccggaggggattagatctgctgtttctaagagaaggtgggttatgtgcagccttaaaagaagaatgttgcttctatgtagatcactcaggagccatcagagactccatgagcaagcttagagaaaggttagagaggcgtcgaagggaaagagaggctgaccaggggtggtttgaaggatggttcaacaggtctccttggatgaccaccctgctttctgctctgacgggacccctagtagtcctgctcctgttacttacagttgggccttgcttaattaataggtttgttgcctttgttagagaacgagtgagtgcagtccagatcatggtacttaggcaacagtaccaaggccttctgagccaaggagaaactgacctctagccttcccagttctaagattagaactattaacaagacaagaagtggggaatgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgacagccctagtgacctatctcaactgcaatctgtcactctgcccaggagcccacgcagatgcggacctccggagctattttaaaatgattggtccacggagcgcgggctctcgatattttaaaatgattggtccacggagcgcgggctctcgatattttaaaatgattggtttgtgacgcacaggctttgttgtgaacccca

SEQ ID NO: 75 - DNA, 8248 bp, Artificial
  ss536 sequence
tgattggtccacggagcgcgggctctcgatattttaaaatgattggtccacggagcgcgggctctcgatattttaaaatgattggtttgtgacgcacaggctttgttgtgaaccccataaaagctgtcccgattccgcactcggggccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgagggggattgttcttttactggcctttcatttggtgcgttggccgggaaaccctgcgaccaccccttacacccgagaaccgacttggaggtaaagggatcccctttggaacgtgtgtgtgtcggccggcgtctctgttctgagtgtctgttttcggtgatgcgcgctttcggtttgcagctgtcctctcagaccgtaaggactggaggactgtgatcagcagacgtgctaggaggatcacaggctgccaccctgggggacgccccgggaggtggggagagccagggacgcctggtggtctcctactgtcggtcagaggaccgagttctgttgttgaagcgaaagcttccccctccgcggccgtccgactcttttgcctgcttgtggaagacgcggacgggtcgcgtgtgtctggatctgttggtttctgtttcgtgtgtctttgtcttgtgcgtccttgtctacagttttaatatgggacagacagtgacgaccccccttagtttgactctcgaccattggactgaagttagatccagggctcataatttgtcagttcaggttaagaagggaccttggcagactttctgtgcctctgaatggccaacattcgatgttggatggccatcagaggggacctttaattctgaaattatcctggctgttaaggcaatcatttttcagactggacccagctctcatcctgatcaggagccctatatccttacgtggcaagatttggcagaagatcctccgccatgggttaaaccatggctaaataaaccaagaaagccaggtccccgaatcctggctcttggagagaaaaacaaacactcggccgaaaaagtcgagccctctcctcgtatctaccccgagatcgaggagccgccgacttggccggaaccccaacctgttcccccacccccttatccagcacagggtgctgtgaggggaccctctgcccctcctggagctccggtggtggagggacctgctgccgggactcggagccggagaggcgccaccccggagcggacagacgagatcgcgatattaccgctgcgcacctatggccctcccatgccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaatttggctaaggtaagagaggtgatgcagggaccgaacgaacctccctcggtatttcttgagaggctcatggaagccttcaggcggttcaccccttttgatcctacctcggaggcccagaaagcctcagtggccctggccttcattgggcagtcggctctggatatcagaaagaaacttcagagactggaagggttacaggaggctgagttacgtgatctagtgagagaggcagagaaggtgtattacagaagggagacagaagaggagaaggaacagagaaaagaaaaggagagagaagaaagggaggaaagacgtgatagacggcaagagaagaatttgactaagatcttggccgcagtggttgaagggaagagcagcagggagagagagagagattttaggaaaattaggtcaggccctagacagtcagggaacctgggcaataggaccccactcgacaaggaccagtgtgcgtattgtaaagaaaaaggacactgggcaaggaactgccccaagaagggaaacaaaggaccgaaggtcctagctctagaagaagataaagattaggggagacggggttcggaccccctccccgagcccagggtaactttgaaggtggaggggcaaccagttgagttcctggttgataccggagcggagcattcagtgctgctacaaccattaggaaaactaaaagaaaaaaaatcctgggtgatgggtgccacagggcaacggcagtatccatggactacccgaagaaccgttgacttggcagtgggatgggtaacccactcgtttctggtcatccctgagtgcccagtaccccttctaggtagagacttactgaccaagatgagagctcaaatttcttttgaacaaggaagaccagaagtgtctgtgaataacaaacccatcactgtgttgaccctccaattagatgatgaatatcgactatattctccccaagtaaagcctgatcaagatatacagtcctggttggagcagtttccccaagcctgggcagaaaccacagggatgggtttggcaaagcaagttcccccacaggttattcaactgaaggccagtgctacaccagtatcagtcagacagtaccccttgagtagagaggctcgagaaggaatttggccgcatgttcaaagattaatccaacagggcatcctagttcctgtccaatccccttggaatactcccctgctaccggttaggaagcctgggaccaatgattatcgaccagtacaggacttgagagaggtcaataaaagggtgcaggacatacacccaacggtcccgaacccttataacctcttgagcgccctcccgcctgaacggaactggtacacagtattggacttaaaagatgccttcttctgcctgagattacaccccactagccaaccgctttttgccttcgaatggagagatccaggtacgggaagaaccgggcagctcacctggacccgactgccccaagggttcaagaactccccgaccatctttgacgaagccctacacagggacctggccaacttcaggatccaacaccctcaggtgaccctcctccagtacgtggatgacctgcttctggcgggagccaccaaacaggactgcttagaaggtacgaaggcactactgctgaaattgtctgacctaggctacagagcctctgctaagaaggcccagatttgcaggagagaggtaacatacttggggtacagtttgcggggcgggcagcgatggctgacggaggcacggaagaaaactgtagtccagataccggccccaaccacagccaaacaagtgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccgaggagttttaacccaaaccctaggaccatggaggagacctgttgcctacctgtcaaagaagcttgatcctgtagccagtggttggcccgtatgcctgaaggctatcgcagctgtggccatactggtcaaggacgctgacaaattgactttgggacagaatataactgtaatagccccccatgcattggagaacatcgttcggcagcccccagaccgatggatgaccaatgcccgcatgacccactatcaaagcctgcttctcacagagagggtcactttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaggatggctgggacggcggtggtggacgggacccacacgatctgggccagcagcctgccggaaggaacttcagcgcaaaaggctgagctcatggccctcacgcaagctttgcggctggccgaagggaaatccataaacatttatacggacagcaggtatgcctttgcgactgcacacgtacacggggccatctataaacaaagggggttgcttacctcagcagggagggaaataaagaacaaagaggaaattctaagcctattagaagccttacatttgccaaaaaggctagctattatacactgtcctggacatcagaaagccaaagatctcatatctagagggaaccagatggctgaccgggttgccaagcaggcagcccaggctgttaaccttctgcctataatagaaacgcccaaagccccagaacccagacgacagtacaccctagaagactggcaagagataaaaaagatagaccagttctctgagactccggaggggacctgctatacctcatatgagaaggaaatcctgccccacaaagaagggttagaatatgtccaacagatacatcgtctcacccacctaggaactaacacctgcagcagttggtcagaacatccccttatcatgttctgaggctaccaggagtggctgactcggtggtcaaacattgtgtgccctgccagctggttaatgctaatccgttccagaatacctccaggaaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaaaaaaatactggaggaaatttttccgagatttggaatacctaaggtaatcgggtcagacaatggtccagcttttgttgcccaggtaagtcagggactggccaagatattggggattgattgaaaactgcattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccctatgaattgctctacgggggaccccccccgttggtagaaattgcttctgtacatagtgctgatgtgctgctttcccagcctttgttctctaggctcaaggcgctcgagtgggtgaggcaacgagcgtggaagcagctccgggaggcctactcaggagaaggagacttgcaagttccacatcgcttccaagtgggagattcagtctatgttagacgccaccgtgcaggaaacctcgagactcggtggaagggcccttatctcgtacttttgaccacaccaacggctgtgaaagtcgaaggaatctccacctggatccatgcatcccacgttaagctggcgccacctcccgactcggggtggagagccgaaaagactgagaatccccttaagcttcgcctccatcgcctggttccttactctaacaataactccccaggccagtagtaaacgccttatagacagctcgaacccccatagacctttatcccttacctggctgattattgaccctgatacgggtgtcactgtaaatagcactcgaggtgttgctcctagaggcacctggtggcctgaactgcatttctgcctccgattgattaaccccgctgttaaaagcacacctcccaacctagtccgtagttatgggttctattgctgcccaggcacagagaaagagaaatactgtgggggttctggggaatccttctgtaggagatggagctgtgtcacctccaacgatggagactggaaatggccgatctctctccaggaccgggtaaaattctcctttgtcaattccggcccgggcaagtacaaagtgatgaaactatataaagataagagctgctccccatcagacttagattatctaaagataagtttcactgaaaaaagaaaacaggaaaatattcaaaagtggataaatggtatgagctggggaatagttttttataaatatggcgggggagcagggtccactttaaccattcgccttaggatagagacggggacagaaccccctgtggcagtgggacccgataaagtactggctgaacaggggcccccggccctggagccaccgcataacttgccggtgccccaattaacctcgctgcggcctgacataacacagccgcctagcaacggtaccactggattgattcctaccaacacgcctagaaactccccaggtgttcctgttaagacaggacagagactcttcagtctcatccagggagctttccaagccatcaactccaccgaccctgatgccacttcttcttgttggctttgtctatcctcagggcctccttattatgaggggatggctaaagaaggaaaattcaatgtgaccaaagagcatagaaatcaatgtacatgggggtcccaaaataagcttaccctcactgaagtttccgggaaggggacatgcataggaaaagctcccccatcccaccaacacctttgctatagtactgtggtttatgagcaggcctcagaaaatcagtatttagtacctggttataacaggtggtgggcatgcaatactgggttaaccccctgtgtttccacctcagtcttcaaccaatccaaaaatttctgtgtcatggtccaaatcgtcccccgagtgtactaccatcctgagaaagtggtccttgatgaatatgactatcggtataaccgaccaaaaagagaacccgtatcccttaccctagctgtaatgctcggattagggacggccgttggcgtaggaacagggacagctgccctgatcacaggaccacagcagctagagaaaggacttggtgaactacatgcggccatgacagaagatctccgagccttagaggagtctgttagcaacctagaagagtccctgacttctttgtctgaagtggttctacagaaccggaggggattagatctgctgtttctaagagaaggtgggttatgtgcagccttaaaagaagaatgttgcttctatgtagatcactcaggagccatcagagactccatgagcaagcttagagaaaggttagagaggcgtcgaagggaaagagaggctgaccaggggtggtttgaaggatggttcaacaggtctccttggatgaccaccctgctttctgctctgacgggacccctagtagtcctgctcctgttacttacagttgggccttgcttaattaataggtttgttgcctttgttagagaacgagtgagtgcagtccagatcatggtacttaggcaacagtaccaaggccttctgagccaaggagaaactgacctctagccttcccagttctaagattagaactattaacaagacaagaagtggggaatgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgacagccctagtgacctatctcaactgcaatctgtcactctgcccaggagcccacgcagatgcggacctccggagctattttaaaatgattggtccacggagcgcgggctctcgatattttaaaatgattggtccacggagcgcgggctctcgatattttaaaatgattggtttgtgacgcacaggctttgttgtgaacccca

SEQ ID NO: 76 - DNA, 7848 bp, Artificial
  ss541 sequence
tggtgctgaagcctgggagggaatggcgagggaatagcgagggaatagggagccagtcatcggggccccaaatccctgagtttgcaacccagggagcagcaggcagtggctaacctctggatcccacccaggtttgttctctgacttaggctctttcccccccaaaccctcttgaacccagccagggaggaacggtgaatcagaactttgcctttctattactgactctgcatccaacaccggcttcctaattctcgggggagtaattgccacctttccgggtcttctgtcagcatggcccctgggccccagttcttctgacacatcagggtgcaaccctctcagacaaacctagcactaggtcagaggactccacgtccactcggtcccagttcctctgatctggggatgcccacatcagaggaccacctctctctccctctctccctctctccctctctccctctctccctctctccctctctccctctctccctctctctctctctctctctctctcaggtctactattcagacctggcagatgcccagcctgaggagtggcactcccaaaggtggtcccttactgatcctccatcccctcttagtcctctttttccttctcatcatggggaacacttcctccactcctccgggaacacgcctcttaggaaattcagatactcctggactaagaggagacattaagtccaagcgtcttaagtttgtaataccgcttggtctcaatggccccaaaacagcacttacgattttaatagcttacatgaccttgataacttttgtcactgtaacagcaagtggcctgaagttgccttctttaccctctgctcccgaccctccttctgcccttctggctccacttcaaagtcttctccttcattcaaaatattcacagccgcctccctctgactctgatgcctcatcctttgatcctgcaggtcatcatcctccccatataaccccctctcagccgccagctctcccaccagctcaccatcttcctcctttccaccctcagcttcctcagctcctcctgatcctaatccagatcctaaccccttttttctcccctcctcatacccagtcccggacccgacctcctgcctccaaagacacctcccaaccggctcctttaccaccttcaccagaagctgcaggagctgaaggggttatccgggtccatgtccccttctccaggtccaacctctttcaaagtgaaaagagacggctccttctcttctgacccctccacctccattaaggaatctgaatatctcacccagtcctatgaccttacctggcttgaagtctgtatcatctcatcctccaccctcttccagaaggaaaagaaagggtctggttggctgctcaggcccacgctgaccacctccagtggcaagataaccaccagccagtcggggcagcagcccccagacaggacccaaactgggacgatcacgtacattcccccccacctcccaaagccgaagacactgtcacagagcaacctgcctcatagcagggctccgaaaagtgacatacagagctgttaactatgaaaaaccgaaggaaattcgtcacggctcagatgaaaagcctgtcctctttctttccacttcacggaggctctccaaaaatatataaatttagacccttcttgagtagaaggaagacttttcttagacactccgtcactcaatctgcacctgacacaagacacaaactacacaagtgggaggagggccctcaaaccccacaatgggatcgcttgagcctcgccttcaaagtctaataattggggtgaagaggctgaaagccaaaatcaggctaaacaccaaacgctagcaactgccattcagggctcccaaaaaatacaggctccctcacaaggacaacagctgtaaggcccctccaggcccatgttacaggtgcagcaagcaggccactgggccaaggcctgccctgactctcgctctcccccaggcccttgtccacagtgtggcaggaaaggccaagtggaaggttggctgtgacctatgcactcgaggaagggccacatccctccctgtggagagaccagaatcatcaaacctcaacctgctgaacctccttggcctggccacagaagactgagggtgcctgggcccctcagcccccacacctatccctccactggaggctcaggaaactctgcgggttgcaggtgagctgatctctttatcgacattcgggccatttacctggcattacctgaatttacaggccccacgcacccccctcaggtctctattgtggggactgacggcctactctccaaatgcttaacgatacccactctaaactgcacctcatcacgaacacccttcagccattcattctgatactacccaggtgcccaaccccaattcttgggagatattcaacctaaattcagaggctcccttacatttctcacacctgcctccatcaccaacccctcctcctcctcactcctccagaacctgagaaaccacctctcccagcctccgctgttttgcccaagaatgggatacctccaccccttccacagctcgacagcatgctcccattcaaattaagttaaaagacccatccacagacccctgccaaccccaatatcctttgtcccttgaaagtagaaggtgcctccaacctattgttaaccaccttctttctcctaacttactctaacccactcactccccactgaacactctaatcctaccagtaaaaaagtcagaaggcccttactgcctcgctcaggatctccccattaaaaaccaggcagtccttacaactcaccctgtggttcctaacccctacaccatcctaccccttattcccccagatacctgccacttcatggtactcgatctgaaggatgccttctttcctatccctttacacccagactctcgggacctttccaccttcacctggacagatcctgacacctaccaatcaagtcagcttacctggatagtccttccccggggttttccagacaggccctagcttctgatctcaccactcttgatctcatccccagtaccctccttcaacaagtagatgacctcttattctgtagcccatctcatgacacttcttttcagctcacggcaacacttttaaatcacctggctgacaaaggatatcgggtctctctcaccaaagctcaactttctgctccaggtcaaatatctcggactgtctatcacccacccacctacccccaccttacccagccccaacttcgtgctatcactgtggacagaaaacagctcactgcctctctctctcttctcactttccaacaggaactcctatcttaccttgaccttgtggaattcctccatatctggacccccaacttcaggcttttggtccgtcccttataccaaaccaccaaagggctctaacggagccaatggaccctgctgtcactattacagctcccttccataaattacagcaggcccttatctccgcccctacttgctcccttcctgacttatcacaacccttcaaactctacaacagaaagagaaggaagagcacttggtctgttgggacacgataagggaccagatagtcaagttgttgcctacctttcaaagcaggtagatgccacggtcaggggatggccagcttgtctgagagccccagccgcagctgccctcctaacattcgagagcaaaaaaactcaccttcggacagtctaccagagtctattccacacataacccccggaccttctctcatataaagccattcaaagtctttctccctctggtagacaggagctttatctggcttttatcaagtcacccaacatacatttagccagaggcccccatgccgaccctatctggctaccttttcacccatcccagacaggaaaccttacattcctgcgaggaaattttagatttcaaaacaccgtacctcgctaacatttcacaccatcccttgcctaaggcttctcataactggtttattgatggtggctcctctcaggatggaaagagggtggcaggatatgtggtggtttctcttgaggaggtcacagaatctaacccccttccaagaggaaccacctcccaaaaggcagaagtaattgcccttactcgagccctggtcttagctgcaggacaagaagcaaacacttacaccgactccaaatatgcctcccatatccttcactctcatgctgagatctgggaagagagggggttcctcaccatgaagggctccccataatcaaagctcccttaatccttaagcttctccaaggcagctattggcattcatttatggggcatcacgtgggatgtgatcccctcattcagggtaaccatgaggcagatacagaagctgagagggctgctctactccaagccccttcccctcaactcctagctcttccatatgttacagcacaacactcctggaagggcaatccttcttagcatctggaacagtcagggaaggtgcgggactaacaatacaagcaaagtacctcctacccaaggaccaagctcggcacatgttaagggacattcgtgattctccacacaatgggtaaaatcctttctaacaactctgaaggcactcggggcattttccctctcttcttcactcttccctgtgacacgatccccttatactcttccaccaagcatttattgggaaaacagatccctctctctagattaacagtcctctatgaagagaccatactgtccttatccagtctgcttccaccgaacttttaaccccccatgtcccctcccgctacaaacaccatctatacgagctgctgcctctttgtatcttcacagtcatatcctcagcttcttgtgggaaccactactacacggagactgcgactacccatggagatggatcacgcgccttctggatccttcttgaaagactgtcccatgcatgagagccccaaatcttccttttccaccttactaaccctcatacttctctctcaacacctgccctctcctggagggtctcgtcaatcccctcacccctactgtccagactagagcacaggctactaatctaaccaagggctggatttgtctgaaaacttttcaggagtcctcaacagtcttacgggcctttttaagtccagagatccttcttagcctaactttaaattatcataagcctccattttcccaaaagatcaatagcttgagactgatttaagtaaatttccaggagtctctcaactgacaggggaagttactcatttggctgagaagacctttctctgtttctaacatagataagactacaaccggtccttacccctaggattcctgaacatttcttactgcaaccacacactctcactcaatgcaactacaggtacatggatgcctatgggtccccaaatgcctggcggcaacaaacacgctctaacacttagaaaatttccaaagtgccatacaaaaacgtatgaacataatctgtctttaataactctcacactatacaccctttgggctgattaaacagactctcaaccaacccttggctaatggaagttttacctcaactggaccaaaaaatgacctctttcatcttttattccaaaatctgctctgtcagcactctccaaaagtagaggcaaaaagacaacaaggaagaaaaaacaggtagcctccacaccgtcctatgcccagaagtcatagaaagatgcctccattgccatcactactgccctctctttattaggacctggatacttcttatgtggcagtgacctgcctggtgcttccaggacattggtcaagtacatgtactatagtcacacgagtgcccaaggcgcaaatccgacaacctcacgaaatggctgcctcagatttaattcctcatctagggtcattcttagcacagttacatctcctctttaggatgttttcaaggttcatctacggtgaggctggtacttactttctttttacggctgaaaaatagataaatgagttgcatacagtggactatctgtccactgacagacatttgagttgttcattagctgctgagccacgaagggcactccactattataaaacagttaagaaaaataggagttggagttcccgtcgtggcgcagtggttaacgaatctgactaggaaccatgaggttgcgggttcggtccctgcccttgctcagtgggttaaggatccggcgttgccgtgagctgtggtgtaggttgcagacgcggctcggatcccgcgttgctgtggctctggcgtaggccggtggctacagctccaattcaacccctagcctgggaacctccatatgccgcagaagcggcccaagaaatagcaacaacaacaacaacaaaaattaaaaaaaaaagaaaaataggagttcccattgcggctcagcggttaacaaactccactaggattcatgaggatatgggttagctccatggccttgctcagtgagttaagaatccagtgttgctgagaactgtggtgtaggtcgcagaagtggcttggatctggcgttgctgtggctgcagtgtaggcctgcagttgtagctctgacttgacccctagcctgggaatttccatatgccacgggtgcagggccaccccccaccaaaaaagaaaaggattttgtcttcatttattctttccataatactctgtattcatataggccccaatttctacctgtataattttacttatccctgaagacctttttataatcttttttttttttttttttttttggctttttgctatttctctgggccacttctgcggcatatagagattcccaggctaggagtctaatcggagctgtagccgctggcctacgccagagccacagcaacgcgtgatccaagccgcgtctgcaacctacaccacagctcacggcaaccccggatccttaacccactgagcaaggccagggatcgaacccgcaacctcatggttcctagtcggattcgttaaccactgcgccacgacgggaattcccccgaagacctttttaaaatcatttagcccagatctgctgtgatgcattcccctcaatttttgtttgtctgataaagactttatttcacctcttttgaaagagctggatgtagaattcgaggttggtgattccccccccccccaaaaaaaaaaatctcacttcactctttttgcttacatagtttctaacaagaagttttttgtaattcttttctttgttcctctataagtgaggtattgttttctctgtcttctttcaaaatttcctctttgctttggtgttccgcattttgagtataactagttgttgttttttaaactgttatctcaccttttgttctgtttatttctacatttgtggtttggtgtccatgattaattttggaaagttctcagccattattatttcagatatttttctgcactgtgttctttttttccctctttctgatattcagttacatctttacattatagtaaagaaaaggagccagacataaaaggcccatatactgtacgattttcctttataagaaattagactacaagagcagataggtagtcaccagatgctgtggtgagatgagaatataagcagtaattgcttagagattacaggattttattctggagtgatgaaaatgttttggaacaagacagaggtagtggctacacattatgaatgtgccaaatgccacagatttgtttagggtaaaatggtccattttatgctatgtaaatttatacatcaaagaaaataaagaaaaaatagggaaggagggt

SEQ ID NO: 77 - DNA, 1613 bp, Artificial
  ss549 sequence
tttggagtatggcaaggtaaagaggagggaccaactgaatttttggaaagactcagaattcagataagaatgtatggtggaatagattccattgaccctctgggagagggcatgctcaaatttcacattgtaactaatagttggccagatatttccaagaagttacaaaaagtagaggattagaaagataaaccattggaggacctattaaaagaggcacaaaatgtttatgtgagaatagatgaggaaaagcaaaaacaaaggaccaagatcatgtttgcacagcaacaaaaataggcggatcaaatcaaaggggtcctaaggacaaaagtaagagagaatcacaatatcagcctcactgctacccagaaacaggacataaaggaaagaggaatagagggcaaggtgaaaacaagggctttatgtgtggcaaattgggacatttcaaaagggaatgccctaaatgaaaaaaagaggagaaaacaatccctctcatgttatttgaggaggatgaggactaggaaggtcaggggctctcaatagtgattgaccaacttaaaaatccacaggtgccctacccagagctcttgataaatttagaagttgggccataccatgaaactatgatttttcttattgattcaggggcgtctcgctccttgctttgttatttgcccaaagggatttctccttctcatgaacagatacttgtatctggggtagaaggggagggattttcagcaaaaattttagaaaaaatcaaagtaaatttccaaaacagatgtgccaaaatatgcttcctttttgttccaaagactggcacaaacctgtgtggaagagacctaatggccgaattgggactgggtttacaggttaccaaaaaaactttacaagtaaaattaaatcttttaaccccaacagtggagggacaaattcaaccacaattgtgggcatcagagggaaatcgtgggggacttaaagtgaccccaattaaaatacagttaaagatcccagagaagtagtccggagaaaacaatacaccatccctctacaaggaaggatgggacttaagccaattatagagggagtactttgagagggtttcttagaaccctgaatgttttcctataataccccttttctccctgtgcataaggcggatgagtcctattgcttaatccaggatttgcgggcaattacccagattgttaagactaaacatccaggggtcccaaaacctcataccctcctgagaaaattccatttgaccaccaatggttcagtgtaattgacttaaaagatacctttggacacggcccctggacttggaatgtcgggacctattccttttctaatgggaggacccagtaactgaaagaagacaaaaatatagatggacagtcctctcccaggggtttacagactccccacatctttttggacaaattttagaacagagactttacaccccctcacgggacctgtctactccaatatgtagatgacttgttactctcaaacactgatcaaaagaaacttacagcagctacagtctcccttctcaattttcttggggagaacaaggccttaaggtttccaagaagaagttacaa

SEQ ID NO: 78 - DNA, 7193 bp, Artificial
  ss503 sequence
tgcacgtgtcttcattgtttgatcacaggcctcctgttttgggcactcatcaactgttaggtggggtaggatggacaccttgacctgggcgattcaaaacaggctgctggggtggggaacactggcccgagaatgggatcataagatagaacactatcctacaactaggcttcatttcaattggcaggggaaaccgagggaaatacactctgtgcaggtaatcttccatctgaggggtaacaggagctaagtcataagtgtggattggatattgaccagaggtgcgatcccactagagaccagataatgggaggggtctctctacctcaggagaatttaaaacctcatgaggtgaccccaaaggtcccccaaagccgtccagaattacctccttccttgagaccaaacttacagttaggaataatggggacatgctcacaagtccaaaaatggaggaaaggagaccatgtccaaggttaaaatgtgcccattagtagagacagaaaggggaattggggccccaaagactattacccaatccctcctctccttgaactaaaacaaatcaaacaggtcctggggagctatatagacaagacaagccactctatagatgccttccaatgtgccttgaactggaaagatataatggtgacccccagggagactctgacaggcccaggacagagtccaaagatcaggaaagctaggaaatatgacactgggctccacaagtctcattgcaggtagccagagaaggaattgccaggcctcccctcagaacctaagtgggaattaaaataacccaggccatatttgggaaagagaccattaactcctatgtatcaaagtgcctaaagtcatcagcatgcaaaggtagctgcagtggaccagggacccaaggaaaaccctattgcattcctggaaaggttatgtcaggcaccctagaaattcacaaccttagacctggagtcctaggaagggcaggtcatcttaacggataaaaattcctgacccagtgtacatcacacatgagaatcacatctgagaatgtaccacagcaggaccctggggccacactagatgagagggtccaagtggtcactgatgcctgttacaacagggagcaggaaagggagggcaaggctcaggaggatgagaagaaaaagcaactggggcctgcccaaatgcttatggcctccaggggaacactcagatctccactaaagcccctagaagtaaaccagatgggaaatgccggatttgccgacagctggggcattgggccaaagagtgtctgagatggagccgaccacctaaaacagcttgccctacgtgtcactgacatggatattggggagccttctgcccccggggcccctgggtcagaagcaaacccaaaggtaatggtggtccaatgggactgaagccacccactccatcccaccccactttctggcatcatcctcaaggggctggagctaagggtacaacaggacacggcaggtaggccaaaagttttcttgtaggaacctggggctgcctactccttttcaatctcctactcaggacccttctcctctcaggcctgcaccattctgggagtcacagggaaagccaccactaggcgcatcccgctgacactactttggtggtgggatatagtaacattcacccatagcttcctggtgatccccaaatgccccattcccttacaaagaagggacctgctctccaaggtgcgaatccctgtacctctaggttggactcccagcccaagccccttgcaaccccgtagttgctccagggaacaaaaaccacctgagcctcaggaggcagaaccttgggaattgaatagtgacccccagctctggcaccagagaatatctcaatgagctcacagggcattctaggtggcaatctcccttaaagaccccaccatagttcccaagcaaagacagcctctccttgaaagggagcctgaggaaagactacaacccatgattaacacatccctggtgtgtgggttgctggagcccaccctctccccatgtatcattccactattcctggtgagttgaaaggatgggacctggtgaatgctccaggactgaaggatcgtaaatgaggtggtccccttgcatcccaccgtacttaacccttatgtgctgctcagagagattcctccagggtctcaatagctcatggctcctgacctaaaatgggtctttttctacattccactggcaaaggaatcccaattcctctttgcctttgcgtggaatgcccctgaaggaaaccctcagcagttcccatggatagtcctgcctcagggatttagaggcaacacccttcactttggacagggacctaagagaattacacttagcacagctcattctaaggaaggaggaaagctgttacactatgtagatgatactctcatttgtcgactgagccaaaaagaatctcaacaacacacacaactggttctcaactctcttgccgaggtgggctaccagttctctaaggccaaatcccagcttgtgaaacaggaggtctcgtaggtgggagtaatcctcactctgggatcttgatggctgccatctgatcaagtgtagagcccattccagctgcccaatcccatgacctgaaaacctctaccagccttcttgagacttacataccaggtactgcaggctgtggacacccacttatgggctcatctttatacctggtgtgagctgtctggagggattggtaaaacctgccctgtctgctggctgttgtacatgggatgtgataaggcactaaacaggtggtgatggcatctggaagtttggctttacagaaagcacgatcaaacttgatagctaatgctctcagtggcaaaccttcctaagtagagctgaacacccttagggagggtattcttgagggagtggaaaagtgttttgaagaagaaaggctgaagtgtgttgtattcacacttgtcacggctctcaaagcccaggaagggcctcgccagcttaagatccatgtttccattgtgaatgagaggcagaaatctttcatccagacaatactccttctggaaggagcttcctactcaaggctcaagtgtcagggagtttttagaggttttatctcttaatgcaagcatattcttgctctatgctgtgctcaaaatgacaggatgtaggaaggggatgaggggaggggcgatggtgttgaggggtgtgagtaggggatttggggaggtgactaggaatgagagacgtgagcagggtgagtggggtggcagcatgctgacaggaggaaaggagagggccaaggcagagccctgagagagcccttggtgtcagtggaggttaggcatggcccaagttaggtgggcctcctgccttcattccctttgactcaggagaggggtttgccatgtgggactacccagagagctcatggctttcgaaggaggaggtgctcacaggtactggcctcatgattgggctgtagatttctgggtggtgtggcagggcttgccttcattctgtgtggggacgaaggggaagaagtgaggaggaagtggaggatggtgaggatcagaacaagagaggtggagagagctggaggtgaatccaggaggtgcaggagaggggcccaggggttgtcctgccagcaaatgggctctgctctagccgtggaccatcaggagggtggaagcaccagaccccaggcatcaatgcccgggcttgtatcccctgggatgtctccttgaatgacctagagacctggtcttgtattctccacccacatctcttctgggctgagggcatgaggatggatgtggtccagaaccactgatggggagaagtcagcatacaactcaccatccccttctggaataatcttaggggtgatgacaggccaggtagcacagcccatcagaaagtaagcgatgaacccagatccttcctctgtggccacgaagggattctagctccctcattgccacctctcccatctggtcagcaggtaagctcatgtgccctccccttcagcccaatgagcttctcaggggtgggggagctgcctggttttctcattgctctgatcctagcccctgaaacccccaaagcctggctctttcccactgcctacccatccctggagtcccttggcatctggctaggaggagctgtggcagtgccagctctgggaaacctagctgctcctctcatctcctgctgaattatgggcataaggagaaacctggacctacactgaatccttcctgatggatgggataagcaagggagactggtacttcaaggagaagtcagggaaggtggtgacctcaccaacactcctcagagacccctacccccaactccacacagggagaaattctccccatgggttggatgtgtatttagggttggcaggtgccaacgtttaaaataggaatggataatggggtcctactctagagcgcagggaactctatccagtctcatgggctgcaacatgatggcagacaatttgagaaaaattttatacacacacacacacacacacacacacacacacacacacaaacacatatatacatgactgggtcactttgctccacagcagtagttggcacaacactgtaaatcaaccataatttaatttctttaaacattatttctggaaactgacaaaaaaagatgatttggtacatatatgctatggaatactagtcagacaaagacaatgatgaaataatgccacttgcatttacatgcatagacctagagatactcgtgctcagtgaaataagtcagccagagaatgccaaataccacatgatatcacttggatgtgcaatctaaaattgaacacaatgcctttttatgaacctgaaagagactcacagacatagagaacagacattatgccaaggggagggggaagtgaggtggatggactggggattggggtgagtagatggaaattgttacatgtacaatgggaaagtgatgaggtcctactgtatagcacaaggaactctatccaatctcctgtgatataccctgatggaaaagaatatatattaaaaataacccaaaaccttaaagcatatctatttatctcagagctgaaaaccagggctgcattttcaattccagaaagatggagaagatgcacatggccctactccttccaggaagtgcaaggaaaaccccaggatgttttatagaaaataaacataagaccatgagaaggaaagagaagaaggcagatgggttggggccagggacccaaggaagaccacattggtcagtttagttttgtttgtttgtttgtttttccctttggtttagccctgtactgacagcatatggaagttccctgtctagggatcacattggagctgcaatagacactggcctgtgccacagcaacagtaacagcaacagcaacagcaacagcagatccatgccttgtccgtgaccctacaccagagctcatggcaaaaccagatcctcaacccactgagggagaccatgggtggaacccaccttctcatggatgaaactagatttcattaccactgagccccaactggaactctggtctaacagttctcacaagttctaactgctcaaccttcaacatgcttagtacacttacattaacctacagttgggccaaaccatctacaacagcagcgacttatataatataattttgaatatctcatgcaatgtactgaatactggagtgaaggttaaaaccagaaatgtgtctgggcccatggatgttaagtgtgttggttgttcaccctcacaactgtgtgcctaatggggatccgcatctcacagcccctgcccaacatcccaagaggatggtaccacctgtcacccgggcaagatcaaaattcaatgtatggtttcttcagaatatgtgctactttcacaccttcaaaaggttgaaatgttgtaagttgaacgcatgtaagctgagggccataagtagaagaactagttgggaaagttagaactgaataactcaataaccaaaataagctcagtgaatggactcagcatgagaatggagggaatagaagaaacaatccctgaactggaaactgggagtattgaaactaaccacatcaagcaacagagggataataaacgaatgaacaaacaagcaaacaaacaaaaacagagcctctgggacctgtgggactctaacccaatttcagcatttgactccccagagtcccagagagagagaagtggggaggagagctgtggaaggtaatacatttatatgatataatgcctagaatcaacatgtagaaaactgtatgaaactcaatgattatatgtaaagaaaaatggaaatctaataaagccctgaacgaacccataagcaggcaggataaagagaagaaaaatggaacaaaaaagaaagccgtaaaacaaaaatggtagagtgaaggcctaccacatcagtaattgcattcaatgtgaacagtcaacctgcatcggtaaaaagagataagcagggctcccactgtggtattgtgggttaaggacccagccttggcgcagctgtggcatgggttggcacatattgaaccctggcctgggaccttccatatcccatgcgcatggcaaacataaaataatcaataaaatacagagagagagtgagggagagagagagagagaaagagattagcagactagattaaaaatattttaaggcagttcccattgtggctccgcaatgatgagcctgactagtatccatgaggatgtgagtttgatacgttccctgactcagggggttgaggatccagcgttgctgtgagctctggtttaggttgcagacattgcttggacaccctgctgctgtggctgtggtgtatcccagcagctgaagcaccaatccaactggacgcctagccagggatcttccatttgtcacaggtgtggccctaaaaatacatacatacatacatacatacatacaaacatacataaaacaagtaaataaatatacatagtcccttctctgaaagggactgtctaaatgcacattgtggacacagagccagatcaatggaaaacctcccctttcgggtaatgctaaaatgttccataggatagggactgggaagtgggtgattcaaaaca

SEQ ID NO: 79 - DNA, 8249 bp, Artificial
  ss622 sequence
tgattggtccacggagcgcgggctctcgatattttaaaatgattggtccacggagcgcgggctctcgatattttaaaatgattggtttgtgacgcacaggctttgttgtgaaccccataaaagctgtcccgattccgcactcggggccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgagggggattgttcttttactggcctttcatttggtgcgttggccgggaaatcctgcgaccaccccttacacccgagaaccgacttggaggtaaagggatcccctttggaacgtgtgtgtgtgtcggccggcgtctctgttctgagtgtctgttttcggtgatgcgcgctttcggtttacagctgtcctctcagaccgtaaggactggaggactgtgatcagcagacgtgctaggaggatcacaggctgccaccctgggggacgccccgggaggtggggagagccagggacgcctggtggtctcctactgtcggtcagaggaccgagttctgttgttgaagcgaaagcttccccctccgcggccgtccgactcttttgcctgcttgtggaagacgcggacgggtcgcgtgtgtctggatctgttggtttctgtttcgtgtgtctttgtcttgtgcgtccttgtctacagttttaatatgggacagacagtgacgaccccccttagtttgactctcgaccattggactgaagttagatccagggctcataatttgtcagttcaggttaagaagggaccttggcagactttctgtgcctctgaatggccaacattcgatgttggatggccatcagaggggacctttaattctgaaattatcctggctgttaaggcaatcatttttcagactggacccggctctcatcctgatcaggagccctatatccttacgtggcaagatttggcagaagatcctccgccatgggttaaaccatggctaaataaaccaagaaagccaggtccccgaatcctggctcttggagagaaaaacaaacactcggccgaaaaagtcgagccctctcctcgtatctaccccgagatcgaggagccgccgacttggccggaaccccaacctgttcccccacccccttatccagcacagggtgctgtgaggggaccctctgcccctcctggagctccggtggtggagggacctgctgccgggactcggagccggagaggcgccaccccggagcggacagacgagatcgcgatattaccgctgcgtacctatggccctcccatgccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagtgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaatttggctaaggtaagagaggtgatgcagggaccgaacgaacctccctcggtatttcttgagaggctcatggaagccttcaggcggttcaccccttttgatcctacctcggaggcccagaaagcctcagtggccctggccttcattgggcagtcggctctggatatcagaaagaaacttcagagactggaagggttacaggaggctgagttacgtgatctagtgagagaggcagagaaggtgtattacagaagggagacagaagaggagaaggaacagagaaaagaaaaggagagagaagaaagggaggaaagacgtgatagacggcaagagaagaatttgactaagatcttggccgcagtggttgaagggaagagcagcagggagagagagagagattttaggaaaattaggtcaggccctagacagtcagggaacctgggcaataggaccccactcgacaaggaccagtgtgcgtattgtaaagaaaaaggacactgggcaaggaactgccccaagaagggaaacaaaggaccgaaggtcctagctctagaagaagataaagattaggggagacggggttcggaccccctccccgagcccagggtaactttgaaggtggaggggcaaccagttgagttcctggttgataccggagcggagcattcagtgctgctacaaccattaggaaaactaaaagaaaaaaaatcctgggtgatgggtgccacagggcaacggcagtatccatggactacccgaagaaccgttgacttgggagtgggacgggtaacccactcgtttctggtcatccctgagtgcccagtaccccttctaggtagagacttactgaccaagatgggagctcaaatttcttttgaacaaggaagaccagaagtgtctgtgaataacaaacccatcactgtgttgaccctccaattagatgatgaatatcgactatattctccccaagtaaagcctgatcaagatatacagtcctggttggagcagtttccccaagcctgggcagaaaccgcagggatgggtttggcaaagcaagttcccccacaggttattcaactgaaggccagtgctacaccagtatcagtcagacagtaccccttgagtagagaggctcgagaaggaatttggccgcatgttcaaagattaatccaacagggcatcctagttcctgtccaatccccttggaatactcccctgctaccggttaggaagcctgggaccaatgattatcgaccagtacaggacttgagagaggtcaataaaagggtgcaggacatacacccaacggtcccgaacccttataacctcttgagcgccctcccgcctgaacggaactggtacacagtattggacttaaaagatgccttcttctgcctgagattacaccccactagccaaccactttttgccttcgaatggagagatccaggtacgggaagaaccgggcagctcacctggacccgactgccccaagggttcaagaactccccgaccatctttgacgaagccctacacagggacctggccaacttcaggatccaacaccctcaggtgaccctcctccagtacgtggatgacctgcttctggcgggagccaccaaacaggactgcttagaaggtacgaaggcactactgctggaattgtctgacctaggctacagagcctctgctaagaaggcccagatttgcaggagagaggtaacatacttggggtacagtttgcggggtgggcagcgatggctgacggaggcacggaagaaaactgtagtccagataccggccccaaccacagccaaacaagtgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccgaggagttttaacccaaaccctaggaccatggaggagacctgtcgcctacctgtcaaagaagcttgatcctgtagccagtggttggcccgtatgcctgaaggctatcgcagctgtggccatactggtcaaggacgctgacaaattgactttgggacagaatataactgtaatagccccccatgcattggagaacatcattcggcagcccccagaccgatggatgaccaacgcccgcatgacccactatcaaagcctgcttctcacagagagggtcactttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaggatggctggggcggcggtggtggacgggacccgcacgatctgggccagcagcctgccggaaggaacttcagcgcaaaaggctgagctcatggccctcacgcaagctttgcggctggccgaagggaaatccataaacatttatacggacagcaggtatgcctttgcgactgcacacgtacacggggccatctataaacaaagggggttgcttacctcagcagggagggaaataaagaacaaagaggaaattctaagcctattagaagccttacatttgccaaaaaggctagctattatacactgtcctggacatcagaaagccaaagatctcatatctagagggaaccagatggctgaccgggttgccaagcaggcagcccaggctgttaaccttctgcctataatagaaacgcccaaagccccagaacccagacgacagtacaccctagaagactggcaagagataaaaaagatagaccagttctctgagactccggaggggacctgctatacctcatatgggaaggaaatcctgccccacaaagaagggttagaatatgtccaacagatacatcgtctcacccacctaggaactaaacacctgcagcagttggtcagaacatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaaaaaaatactggaggaaatttttccgagatttggaatacctaaggtaatcgggtcagacaatggtccagcttttgttgcccaggtaagtcagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccctatgaattgctctacgggggaccccccccgttggtagaaattgcttctgtacatagtggtgatgtgctgctttcccagcctttgttctctaggctcaaggcgctcgagtgggtgaggcaacgagcgtggaagcagctccgggaggcctactcaggagaaggagacttgcaagttccacatcgcttccaagtgggagattcagtctatgttagacgccaccgtgcaggaaacctcgagactcggtggaagggcccttatctcgtacttttgaccacaccaacggctgtgaaagtcgaaggaatctccacctggatccatgcatcccacgttaagctggcgccacctcccgactcggggtggagagccgaaaagactgagaatccccttaagcttcgcctccatcgcctggttccttactctaacaataactccccaggccagtagtaaacgccttatagacagctcgaacccccatagacctttatcccttacctggctgattattgaccctgatacgggtgtcactgtaaatagcactcgaggtgttgctcctagaggcacctggtggcctgaactgcatttctgcctccgattgattaaccccgctgttaaaagcacacctcccaacctagtccgtagttatgggttctattgctgcccaggcacagagaaagagaaatactgtgggggttctggggaatccttctgtaggagatggagctgcgtcacctccaacgatggagactggaaatggccgatctctctccaggaccgggtaaaattctcctttgtcaattccggcccgggcaagtacaaagtgatgaaactatataaagataagagctgctccccatcagacttagattatctaaagataagtttcactgaaaaaggaaacaggaaaatattcaaaagtggataaatggtatgagctggggaatagttttttataaatatggcgggggagcagggtccactttaaccattcgccttaggatagagacggggacagaaccccctgtggcagtgggacccgataaagtactggctgaacaggggcccccggccctggagccaccgcataacttgccggtgccccaattaacctcgctgcggcctgacataacacagccgcctagcaacggtaccactggattgattcctaccaacacgcctagaaactccccaggtgttcctgttaagacaggacagagactcttcagtctcatccagggagctttccaagccatcaactccaccgaccctgatgccacttcttcttgttggctttgtctatcctcagggcctccttattatgaggggatggctaaagaaggaaaattcaatgtgaccaaagagcatagaaatcaatgtacatgggggtcccgaaataagcttaccctcactgaaatttccgggaaggggacatgcataggaaaagctcccccatcccaccaacacctttgctatagtactgtggtttatgagcaggcctcagaaaatcagtatttagtacctggttgtaacaggtggtgggcatgcaatactgggttaaccccctgtgtttccacctcagtcttcaaccaatccaaagatttctgtgtcatggtccaaatcgtcccccgagtgtactaccatcctgaggaagtggtccttgatgaatatgactatcggtataaccgaccaaaaagagaacccgtatcccttaccctagctgtaatgctcggattagggacggccgttggcgtaggaacagggacagctgccctgatcacaggaccacagcagctagagaaaggacttggtgagctacatgcggccatgacagaagatctccgagccttagaggagtctgttagcaacctagaagagtccctgacttctttgtctgaagtggttctacagaaccggaggggattagatctgctgtttctaagagaaggtgggttatgtgcagccttaaaagaagaatgttgcttctatgtagatcactcaggagccatcagagactccatgagcaagcttagagaaaggttagagaggcgtcgaagggaaagagaggctgaccaggggtggtttgaaggatggttcaacaggtctccttggatgaccaccctgctttctgctctgacgggacccctagtagtcctgctcctgttacttacagttgggccttgcttaattaataggtttgttgcctttgttagagaacgagtgagtgcagtccagatcatggtacttaggcaacagtaccaaggccttctgagccaaggagaaactgacctctagccttcccagttctaagattagaactattaacaagacaagaagtggggaatgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgacagccctagtgacctatctcaactgcaatctgtcactctgcccaggagcccacgcagatgcggacctccggagctattttaaaatgattggtccacggagcgcgggctctcgatattttaaaatgattggtccacggagcgcgggctctcgatattttaaaatgattggtttgtgacgcacaggctttgttgtgaacccca

SEQ ID NO: 80 - DNA, 8249 bp, Artificial
  ss623 sequence
tgattggtccacggagcgcgggctctcgatattttaaaatgattggtccacggagcgcgggctctcgatattttaaaatgattggtttgtgacgcacaggctttgttgtgaaccccataaaagctgtcccgattccgcactcggggccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgagggggattgttcttttactggcctttcatttggtgcgttggccgggaaatcctgcgaccaccccttacacccgagaaccgacttggaggtaaagggatcccctttggaacgtgtgtgtgtgtcggccggcgtctctgttctgagtgtctgttttcggtgatgcgcgctttcggtttgcagctgtcctctcagaccgtaaggactggaggactgtgatcagcagacgtgctaggaggatcacaggctgccaccctgggggacgccccgggaggtggggagagccagggacgcctggtggtctcctactgtcggtcagaggaccgagttctgttgttgaagcgaaagcttccccctccgcggccgtccgactcttttgcctgcttgtggaagacgcggacgggtcgcgtgtgtctggatctgttggtttctgtttcgtgtgtctttgtcttgtgcgtccttgtctacagttttaatatgggacagacagtgacgaccccccttagtttgactctcgaccattggactgaagttagatccagggctcataatttgtcagttcaggttaagaagggaccttggcagactttctgtgcctctgaatggccaacattcgatgttggatggccatcagaggggacctttaattctgaaattatcctggctgttaaggcaatcatttttcagactggacccggctctcatcctgatcaggagccctatatccttacgtggcaagatttggcagaagatcctccgccatgggttaaaccatggctaaataaaccaagaaagccaggtccccgaatcctggctcttggagagaaaaacaaacactcggccgaaaaagtcgagccctctcctcgtatctaccccgagatcgaggagccgccgacttggccggaaccccaacctgttcccccacccccttatccagcacagggtgctgtgaggggaccctctgcccctcctggagctccggtggtggagggacctgctgccgggactcggagccggagaggcgccaccccggagcggacagacgagatcgcgatattaccgctgcgtacctatggccctcccatgccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagtgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaatttggctaaggtaagagaggtgatgcagggaccgaacgaacctccctcggtatttcttgagaggctcatggaagccttcaggcggttcaccccttttgatcctacctcggaggcccagaaagcctcagtggccctggccttcattgggcagtcggctctggatatcagaaagaaacttcagagactggaagggttacaggaggctgagttacgtgatctagtgagagaggcagagaaggtgtattacagaagggagacagaagaggagaaggaacagagaaaagaaaaggagagagaagaaagggaggaaagacgtgatagacggcaagagaagaatttgactaagatcttggccgcagtggttgaagggaagagcagcagggagagagagagagattttaggaaaattaggtcaggccctagacagtcagggaacctgggcaataggaccccactcgacaaggaccagtgtgcgtattgtaaagaaaaaggacactgggcaaggaactgccccaagaagggaaacaaaggaccgaaggtcctagctctagaagaagataaagattaggggagacggggttcggaccccctccccgagcccagggtaactttgaaggtggaggggcaaccagttgagttcctggttgataccggagcggagcattcagtgctgctacaaccattaggaaaactaaaagaaaaaaaatcctgggtgatgggtgccacagggcaacggcagtatccatggactacccgaagaaccgttgacttgggagtgggacgggtaacccactcgtttctggtcatccctgagtgcccagtaccccttctaggtagagacttactgaccaagatgggagctcaaatttcttttgaacaaggaagaccagaagtgtctgtgaataacaaacccatcactgtgttgaccctccaattagatgatgaatatcgactatattctccccaagtaaagcctgatcaagatatacagtcctggttggagcagtttccccaagcctgggcagaaaccgcagggatgggtttggcaaagcaagttcccccacaggttattcaactgaaggccagtgctacaccagtatcagtcagacagtaccccttgagtagagaggctcgagaaggaatttggccgcatgttcaaagattaatccaacagggcatcctagttcctgtccaatccccttggaatactcccctgctaccggttaggaagcctgggaccaatgattatcgaccagtacaggacttgagagaggtcaataaaagggtgcaggacatacacccaacggtcccgaacccttataacctcttgagcgccctcccgcctgaacggaactggtacacagtattggacttaaaagatgccttcttctgcctgagattacaccccactagccaaccactttttgccttcgaatggagagatccaggtacgggaagaaccgggcagctcacctggacccgactgccccaagggttcaagaactccccgaccatctttgacgaagccctacacagggacctggccaacttcaggatccaacaccctcaggtgaccctcctccagtacgtggatgacctgcttctggcgggagccaccaaacaggactgcttagaaggtacgaaggcactactgctggaattgtctgacctaggctacagagcctctgctaagaaggcccagatttgcaggagagaggtaacatacttggggtacagtttgcggggtgggcagcgatggctgacggaggcacggaagaaaactgtagtccagataccggccccaaccacagccaaacaagtgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccgaggagttttaacccaaaccctaggaccatggaggagacctgtcgcctacctgtcaaagaagcttgatcctgtagccagtggttggcccgtatgcctgaaggctatcgcagctgtggccatactggtcaaggacgctgacaaattgactttgggacagaatataactgtaatagccccccatgcattggagaacatcattcggcagcccccagaccgatggatgaccaacgcccgcatgacccactatcaaagcctgcttctcacagagagggtcactttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaggatggctggggcggcggtggtggacgggacccgcacgatctgggccagcagcctgccggaaggaacttcagcgcaaaaggctgagctcatggccctcacgcaagctttgcggctggccgaagggaaatccataaacatttatacggacagcaggtatgcctttgcgactgcacacgtacacggggccatctataaacaaagggggttgcttacctcagcagggagggaaataaagaacaaagaggaaattctaagcctattagaagccttacatttgccaaaaaggctagctattatacactgtcctggacatcagaaagccaaagatctcatatctagagggaaccagatggctgaccgggttgccaagcaggcagcccaggctgttaaccttctgcctataatagaaacgcccaaagccccagaacccagacgacagtacaccctagaagactggcaagagataaaaaagatagaccagttctctgagactccggaggggacctgctatacctcatatgggaaggaaatcctgccccacaaagaagggttagaatatgtccaacagatacatcgtctcacccacctaggaactaaacacctgcagcagttggtcagaacatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaaaaaaatactggaggaaatttttccgagatttggaatacctaaggtaatcgggtcagacaatggtccagcttttgttgcccaggtaagtcagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccctatgaattgctctacgggggaccccccccgttggtagaaattgcttctgtacatagtggtgatgtgctgctttcccagcctttgttctctaggctcaaggcgctcgagtgggtgaggcaacgagcgtggaagcagctccgggaggcctactcaggagaaggagacttgcaagttccacatcgcttccaagtgggagattcagtctatgttagacgccaccgtgcaggaaacctcgagactcggtggaagggcccttatctcgtacttttgaccacaccaacggctgtgaaagtcgaaggaatctccacctggatccatgcatcccacgttaagctggcgccacctcccgactcggggtggagagccgaaaagactgagaatccccttaagcttcgcctccatcgcctggttccttactctaacaataactccccaggccagtagtaaacgccttatagacagctcgaacccccatagacctttatcccttacctggctgattattgaccctgatacgggtgtcactgtaaatagcactcgaggtgttgctcctagaggcacctggtggcctgaactgcatttctgcctccgattgattaaccccgctgttaaaagcacacctcccaacctagtccgtagttatgggttctattgctgcccaggcacagagaaagagaaatactgtgggggttctggggaatccttctgtaggagatggagctgcgtcacctccaacgatggagactggaaatggccgatctctctccaggaccgggtaaaattctcctttgtcaattccggcccgggcaagtacaaagtgatgaaactatataaagataagagctgctccccatcagacttagattatctaaagataagtttcactgaaaaaggaaacaggaaaatattcaaaagtggataaatggtatgagctggggaatagttttttataaatatggcgggggagcagggtccactttaaccattcgccttaggatagagacggggacagaaccccctgtggcagtgggacccgataaagtactggctgaacaggggcccccggccctggagccaccgcataacttgccggtgccccaattaacctcgctgcggcctgacataacacagccgcctagcaacggtaccactggattgattcctaccaacacgcctagaaactccccaggtgttcctgttaagacaggacagagactcttcagtctcatccagggagctttccaagccatcaactccaccgaccctgatgccacttcttcttgttggctttgtctatcctcagggcctccttattatgaggggatggctaaagaaggaaaattcaatgtgaccaaagagcatagaaatcaatgtacatgggggtcccgaaataagcttaccctcactgaagtttccgggaaggggacatgcataggaaaagctcccccatcccaccaacacctttgctatagtactgtggtttatgagcaggcctcagaaaatcagtatttagtacctggttgtaacaggtggtgggcatgcaatactgggttaaccccctgtgtttccacctcagtcttcaaccaatccaaagatttctgtgtcatggtccaaatcgtcccccgagtgtactaccatcctgaggaagtggtccttgatgaatatgactatcggtataaccgaccaaaaagagaacccgtatcccttaccctagctgtaatgctcggattagggacggccgttggcgtaggaacagggacagctgccctgatcacaggaccacagcagctagagaaaggacttggtgagctacatgcggccatgacagaagatctccgagccttagaggagtctgttagcaacctagaagagtccctgacttctttgtctgaagtggttctacagaaccggaggggattagatctgctgtttctaagagaaggtgggttatgtgcagccttaaaagaagaatgttgcttctatgtagatcactcaggagccatcagagactccatgagcaagcttagagaaaggttagagaggcgtcgaagggaaagagaggctgaccaggggtggtttgaaggatggttcaacaggtctccttggatgaccaccctgctttctgctctgacgggacccctagtagtcctgctcctgttacttacagttgggccttgcttaattaataggtttgttgcctttgttagagaacgagtgagtgcagtccagatcatggtacttaggcaacagtaccaaggccttctgagccaaggagaaactgacctctagccttcccagttctaagattagaactattaacaagacaagaagtggggaatgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgacagccctagtgacctatctcaactgcaatctgtcactctgcccaggagcccacgcagatgcggacctccggagctattttaaaatgattggtccacggagcgcgggctctcgatattttaaaatgattggtccacggagcgcgggctctcgatattttaaaatgattggtttgtgacgcacaggctttgttgtgaacccca

SEQ ID NO: 81 - DNA, 7983 bp, Artificial
  ss629 sequence
tgtgtgctctctgtccaagccagcagccctgctaatcaggtacccagcattgcttatcagttctgcttctgtaaccttgcttgctcagtttcttagggaggaacactgtctgcttgaggatgggggaggtccgggatgcttacatgggaaaatcaagaccttgtagtatataaaagttactgagaacaaagacctggtgctcagactctggaggtgactcctctgaccccacaccggtgctgaataaaccttgcttgtccatatctccgagtgctgtttgtctccttccattgccacagtttttgcggtttccacaacattttggtgcgttggccgggaagccgacaaccgagctggcctcttgtgccaccgttgtcggggaactgggggaggccacggtcgctggcccggtgagaggtggatagcgtgcaccggccattttgccatatccagaccctcactcgggccgtggccttggcccacaccgcttcctgaacggactcagaaggagagtggaaacaggttcctggacaggacgtcagactggtgagtgccctggggacatctgcccaagtcaggacccgccatactgcggaaggagagactgatcacctctcagtgaccaaagggtcactcaggtcagggtttgctcccttgggatcgggaggcttgtcaatcctggtgtgtgtgtgtgtgtgtgtgtgtgtgtgtgtgtgtgtgtgtgtgtgtgtgagtgactggagagaatgagagcccgtgctccactgtctttggactacagagccagagtgagtcctaacctgcagttctgcggcgaccctcatacggcttatggtggccctcttcggggggatcctgatgttggggtttatacagtcccacctatgctaagaggcgcctgaaatatctcctctgggggagtggtcaggcggacaaagcgattgttacctgaggccttgccctcactgtttgtcttgcatcaccggcacagggtgggacttcacacaatgggtaaattggcttctgagcccgctgtcttagagtatacggttaagaattttaagaaaggattttctagagattatggtgttaagctgagtcctggaaaactgtgtaccctctgtaccctagagtggccctcctttggtgttggctggcctctggaagggaccttagatgtgttcacagttgcatcagtatataatgttataacaggagaccctggacacccagaccaatttccatatattgatcaatggttggaaattgcctacttgaggcccccataggttcggttctgcaccacagaccagggacagtgtagggtgctagtagcccagtccaagaagaaaaccttgtctcaaaagaaggtgccaccttttatcaaggggaacctgaggactcgccccctatgccaccaccttatgtgctgccggccccacctccaggagctgaaggtccccagatgccagatagcccaccgccttctgtttctcctcctgcttctgcttctgaagttcccgaggcgatatcacccccacagccagattctccagaacctatgagcaggtgtctccgttcagctcagggaacagccactccagcattacaaatgcccttatgggagacactgggaccacagcaaatcacccccgatgggaccatacaagaagggggacgtttttattattaccagcccttttccactgccgatctcctcaactggaaacaccatactccctcatattctgaaaagcctcaggcgctgattgatctcttagaattcattttccagacacactgtcccacctggatagactgccagcaactcctttttactctatttgacactgaagagcactggcgaattgtaacagaagccccaaatgacttcaggccaatgcggggggtcaagcagacttggcaaactgggtgagggaagccttcccagaagaaaacccccactgggactatgagactgaggaagggaaatgtaacctagagaggtaccggcaggccttcctacagggggcaaaagctggggctaaaaagcccactaatatagctaagatcggtgagatacaagatccgaatgaaagcccagccaaattctatgagagactatgtgaggctttccgaacctacacctcttttgatcccgagacccctgagaactaatggatgataaatgctacctttgtgggacaagcccaatcagatatctgtaaaaagctacagaaattagaaggctttgcaggagagaatgccactaaactgttggaaatagccaacaaggtttttattaactgagaccaggtggcctgccatgatgcagaaaagagaatgaaacaaaaagtgactcttccggcagctgccctgtcaaaaccggtgcccccagtgggaccaccccataggggacaaggcacaaggccagggaaaaggagtcccctggaacatgaccaatgtgcttactgcaaagaaaagggacattggaaaaatgaatgccccaactgtcctgagaaaaagaccaaggccccatctagccggtaccaatcagagccattcagcacaacctgatcagcctagctgagtctgattaggggagaccaggctctctccaactgggtccccgagagcctatggtcagaattcaagtagggggccaccccatagactttatggttgacacaggtgccgaactttctgtggttacacaacctgtggctcccctctcagggaaagaaaccaccattgttggggccacaggtaaccaaacccacaggcccttcagcggtccttgacgatgtcggttaggaggtcatgaagtaatacatgaatttctttacctgcctgactgcccagtccccctgatgggaagagacttgctggctaaattggggaccattccccagaactagagagtaaatacccattgttttgggctgaaggaaacccaccaggactggcaaaacactacgctcctgtcttaattgatctaaaacccggagctcaaccagtaaggctatggcaatactcaattcccagagaagctcgactgggaatccaggttcacctggctaggctgcttcagcatggactgttaataaaatgtcagtccccttggaacacccctttactgcccatgaaaaaaccaggaacacaggactattgcccagtacaggacttgagagccataaataaagcaacagtcacattacacccgttcatccctaacccatataccctgctagggctgatcccctccactgctgagtggtttacttgcctgaacttaaaagacacctttttctgcctctgggtggcacctgccagtcagcccttgtttgcttttgaatgggaaaatccacatacagggacaaaggaacagctcacctggactagactcccacaagggttcaaaaactctcccactctttttagcggcaacttagctgctgacctggctaaatttcctggacaaaaactgggctgtgttttgctacagtatgttgatgacctcttactagctggcaccatggaggctcagtgcctagagggaacaagagctctcctttccctactgatggaggcagggtatcgggtatcaaagaaaaaggcacaaatctgcaaaaaacaagtcaagtatctgggcttcaacatcatgcagggccgacgaatgctggggactgaaagaaagcaggcagtttgtgccattcctgtccctaccacctgctggaaggttcatgagttcctaggggcagcaggattctgccggatattgatccccgggttttcagacctggccaggcctctgtatgaggctctaaaaggggaagaaaaggctccccttaaacggggaccaagccaggagacagtgtttcagacaatcaaaactaaactcactgaggctccagccttgggacttcctgatgtaatcagataatttaacctttttcttcatgagaaaaatgggatggctttgggagtcttaactcaagaatttgggccttggcagaggccagtggcatatctgtctaaacaaattgactcagttgctgccggatggcctccctgcctctgagtgctggcagctaccaccttgttggtaagagaggctgacaagttgaccctgggacaaaacctcagtgttaaagtcccacactcagttgtaaccctaatggataccaggggccaccattggctcacacatgcacgaatgactcaatatcaagggttactatgtgagaatccatgggtaaaactggaggttgtacgaactctgaacccagccactttctgccagatgaagcggggaccccagaccataactgcctggagctactagatgaggtgttttccagcaggcctgacttgactgataaaccactccaaaatcctgacctggttttatatactgatggcatcagctttatggaggatggaaaaaagatggcaggaaatgctgtggtatctgacttaaaagtgatagaagcagaggtgcttcctcaaggctggtcaacatggagagcagaattatgggccttaatcagagtactggaactcagccaagaccagcgagttaatatctataccgactcacgatatgcctttacaactttacatgtccatggagccttatataaaaaaaagagggctcttcacggctaaagaaaaaggaattaaaaaccaggctgaaatcttaaaactcctagaggcagtatgggaacctaaagaagctgcagttatccactgtaaaggccaccaaaagggggatgacccagtgacaaaaggaaaccgtagtgctgatgcagctgccagacaggcagctcggggacaacagccaaacaaacctaaggtcttgctggccccaggagtgccagctgtccccaaatattctccagaggaagaaaaatggataagggaggaaggaggaactaaaactaaaacaggatggtgggtcacacgggaccaccgagtttacattccagaacagctggcctacaaactagtccgccaagaacatgagctaacccacatgggcaaaactgccttagagaccctactgggccagtactatctcattgctcgtcttcctgcactctgctcctctgtctcccaaagatgcataaactgtttacagaataatgcccaccaggggccccacagaccagctggggcaactgcggaccgtccccatttgaggatatggaagtggactttactgaggtcacccctagtaaggggtaaaaatatttactagtttttatctgtactttttcaggatgggtagaggccttccctacccgaactgaaaaggcaaggaaagtaaccaaggcactcctgagagacattattcccagatatggaatgcctctgaccatcgggtcagataatggactggcatttgtggctgaaacagtacaacagatggcaaaagctttacagatccgatggaaactacattctgcttatcgccctcaaagttcaggaaaagtagaacgcataaaccgaacccttaaacagaccctggcaaagttatgtcaggaaactggcttgccttggatagacatgttgctggtggccctcttaaaagtgaaatgctcaccccgagcaggaataggattctcaccatttgaaatcttatatggaaggccacctccactaatcagtttaaaaggaaacaccagagagttgggagaattggaattacataaaaaattacaaggactggggctcactatttctcagatacatagatgggtcacagacagaatacctgtgtccttaggtataacagtacacccccacaagccgggggaccaggtgtggataaaggactggaaaaaggagcctttgaggctggtatggaagggcccctatactgtaattctaaccacccccactgctcttaaagtaacaggaatagatgcttggatccatcattctagagtaaaaccggctggcacagctgacaactgtggagagtgggagactgccctcgatctggagagacctcttcgcctgacaatacagaggaggagacgatgatctcaaagccctgctctgaccacaccggaagctggtcagtcaacccacggctaaagcttgagaaatcggctgcctgtgagcccaaatggaaggagggtttcaaaataagcatttgcattgatggaagagaccttggccctggagctgtgctacatttccagagaatcacgtttgagctccaagctgcctctcacagggtctttcattccttttatgaagagataaaaaacaccccacctcccattccggccacaactaagaacttgttcttagccctggcagaaactatcgcacaaactctcaaggtctccttttgttatgtgtgcaggggaacaaacacccggagaccactggccttggcaagccagagaactggacctattagagcctcataatgagactgcatacccccaactcaccattgaggggtatagctcttcagaactgctattatagggagaaattgtcttgcgaggtggggaggatggtttaacgtttcagtaggaagcttaacatgtttaggcctgaggtattataatctgactgcccaaaagactcaatggtggtcatcctccaatcgctcagagcccaagcctaatcccttgtctaacttttcccaccttcgacaagcatgggaagatatcagtactaatatccagtggcgggcaccaaagggattatattggatttgtggaaaaatggcctattccatactccccccaaattgggctggggcatgtgtactgggaacaatcagaccttccttcttcctgctcccattgtcactaggagagcaactgggagttcctatatatagggcacagggtgcccagagagactggagggctctccaaattggagactggaaagatgataaatggcccccagaatggataattcaatattatggacctgccacctgggcagaggatggctcttggggatatcacacccctatctatatgctgaacctcatcatcagactacaggcagttttggaacttataacaaatgacactgcaaggcccttgactatattggcccaacaacaaactaaaatgcacagtgcaatctaccaaaatcgtttggccttggattatttacttgcttctgaaggaggggtttgtggaaaatttaacttaagtaattgctgtctacaaatagatgacaccagaaaggtggtagaagaaattgctgaccgcatgactaaactagcccatgtacctgtacaaacttggaaaggatgggatgcagagagtctctttggtaaatggttctcttagttgggaggaattaagacaatggttggaatagtcatggttatactcgcagggtgcctacttgttccctgccttgtacctctcctgataaatattataaaaggttttataagaaccatggttaaaagaaaaacagcctcccacctgctacttattagaggctaccaaagggttatgactgatgatgatctgtaaagggtgcagatgcaccctgaacatcaagaggggggaatgaaatagagttttaactaaagaacaaccccccttggctaagaaggcagctgcaggcctttccagctatgctcgtcactatgccacccttcttgtaataatgtaacaactgtgtgctctctgtccaagccagcagccctgctaatcaggtacccagcattgcttatcagttctgcttctgtaaccttgcttgctcagtttcttagggaggaacactgtctgcttgaggatgggggaggtccgggatgcttacatgggaaaatcaagaccttgtagtatataaaagttactgagaaaaaagacctggtgctcagactctggaggtgactcctctgaccccacaccggtgctgaataaaccttgcttgtccatatctccgagtgctgtttgtctccttccattgccacagtttttgcagtttcca

SEQ ID NO: 82 - DNA, 8225 bp, Artificial
  mm5882 sequence
aatgaaaaatagcgtgtgttaagatgccataagtcacagggtgcagttggagtatactgaagtgctctcaattggttttgcaagggtgcgtcttagcaaagtcttcctgaaagtcattatctaaattgagactctaaagatgaagataagttagcttatgtgctctcaaagctttaatttttaaaaaacacttcggaagttcatatatactttaaatagtgtccaccatgagggaatgttgccttttcttgtggcataagttaggtagaattgttcttgagactcctttctcagaggtttttattcattatttctactccaattttatattcactctctggcttctgcattctgtccccatcattctgctaaaaaggtgtaagttaatgctacaatgactttccaattgaaaaatacaatgttaactttttaatcattgtattatttggtatccttgagaaaattcaaacctttcaatattcctgcctatttaggggtctctactatttaattatccatccacccagaaatctggaaaccatcccataatacttattttccctcacccatttcatctatgaactttttcttgcctttttaccttgtctttacatacctaccatacccactggacaaacatatggacactatttggtataatttctaaaccaatctcatttggctatcactagctccaagcctttcttaccaataaggtttagaactaagactgatactcaagatttgtaccacattacacaaatgatgtatttccatattgttttgaaaagatttactgtagttgtatttggaaactggtcaatcagagataaaatgcttattcaagtcttattaactcctcctatattgattcatctggttgattcactggcttatatgaacacttgagtaggagttctttccccagcacaccaatatcatctatttaacttggggatagttaaaccatggaaggattagtctcttcatacacaaatttgggttaataatgacacctatttaataagattgttttgaggattaaatgagccaatgcatataaaacaactagtttagtgtcaagtataatgtaattcctcgaactacatattattattattattacaattattattattattactactgccactactctatttgcatgagatccctgttctgaacctcacttttcatgtcctcctaagactgtagtctttgcataacctctgcttaagccagtatgagaaaaacttctggaaatatggtggcagactgtttaactctttagttggatccattactgctttgtcatacctgagggttaaacatctagactgactgaaacatttctgaacctgtaatacccttgttatattttggtctcacttagagctcatgctcagagtccacattcctcaccttggttaatttattttttctagtgtccatttgtattttctttctcaagggatgatgtctctactagaatataagatgattttggaggacagagaagcagacgtttcttctatatggaggaaacaaggaaggattcatggagtggtcatatttaacatggttcatgaaaactggagagaaagtatttctaccattctaaggttgggtagcagaatgaataaaatgatggtggcaacaaaaatgagatgacagcctatggccctgatttcttatttctaaggttcaattatacttaagcatgtctatgcctactgaaatttatgctattggagtaggacttgtctcctgcctacttaccacctgattccaaactacattgagctcagagataagattaaaacctgtccagcttcactaagctcttgtgactgtgtattgacccaatcaaaggagtactgaaacttggaaatatgcccttcattcttattggctaagtatgttataatttttctgctcaatttttgcatgaacatatgggtgcatgtatgtatatttttcaatgaaagttttctctggatatatgcccaggagtgggattgctggatcaaatggtggttctatatttagttttctgaggtacctccatactgttttccatagtggctgtactgatttacattccctctccagcatctattatttgtagacttatcagtgatagatagccattctgaccagtgtagggtgctgcctcattgcagttttgatttgcatatctctaataattagtgatgttgagaattttttttcaagtgcctgttgtcttctttggataaatgtctgtttaggtcttctacccatttttcaattgggttgtttgtgggttttttttgctgttgagttgaatgagttatttgcatattttggagattaagtctttgttggttgcatcatttgaaaatattttctcccattccctatgttgtctttttttttcatggttctctttgctgtgcaaaagcatgccaatatgattaggttatattgctttatttttatttctattgggagactgacctaagaaaacatttgtaaggctgatatcagagaatattttgcttatattctcttctaggagttttatggtggcttgtattatgtttaagtctttaagccatttcgagtttatttttgtgcatggcactagggtttgttttattttcactgatttacatgaggctttccagttttccaagcaccacttccttaatagactgtattttacccatgttatacccttgcctcctttgtcaaagattagttaaccattgatgtctgggtttatttctgggttctgtattctgtttcattgctctgtatatctgtatttgtaccaataccacactgtctcgattactgtaagctttgtaatacagtctgaagtgtgggggagttatacctcctgcttgttttttttttttttttcctactctcttaggatttctttggcaattctggatttttattgttccacataaattttggggttgtttgttctagttctgtgaaaaatatcatgggtaatttgatagggatttcattgaatctgtagattgctttgaccatttttacgattttcagtcttctcacccaggagcatgaaatatctttccatttctttgaatcctctttaatttccttgattaatgttttatagtactcagcatataagtctttcacctccttggtcaggtttatccctaggtatttaattttggggagtgtgattttaaaaggtattatatttttatattcctttgcttattcttcatcattcatatatagaaatgcaactgatttctgaatgttaatcctgtatgctactactttgctgaatttttctatctttttgggtagtttctgtgtggagtcattaaggttttctatatatagtatcatgtacctactcgcttccaatttgggtaccttttatttattttttttgtttgattgctgtggctaggacttccaatactatgttgaaagagggcatccttgttccagattttagtgggaaggctttcagcttttctgtattgaatattatattggctatgggtttgtcataaacagctttgatcatgtttaggtgtgtaccctatatacccacttttgtaagagtttttgttcatttcaaattggttaaaaaatcaaaataatttgatttcatgacatgaaaactactagaattcaaattttcagggtttaaataaagttttattggaatgcagtttcgttaacattaccatgttgtctacttgttttcatgtaacaatgggaaagttgaatagttgtgatagagaaagtatggtatgcaaaatcaaaaatatttactgtctggttctgaatttacagagcaagtgtgataacttctgtattgggtctttagtttccttcataagatacatgcttaggcatttcatgaatgctatcttctcagttctcattaaaaaaagacttgacttttaacagtataaagcctgttttatttatttatttattttattaaagtattgttgatttacaggtttgtgccaatttttgctgtacagcatattgactcagtcacacgttctttttctcgtgctatcttccatcatgttctattccaagagattggatatagggtccctgtgatgtactgtagaacctcattgcctacccattccagttaaacactactgaacatacaagtaagaatgtagccatgctgtaagaaagttcaattgtacattttttcaaagcctcctcctcatctactacatgctatacaggaataaaaacttgctctaattaaaaaaaaaatagtcagaatggaataagtgtcctcatacattgcctgcataggaatacactgtgttacaggctggttgctgtggatggaggtggtacattgatcacttaacagttgttactcagcatctaaaaagaaatccttggaggttttctttttggagcagtaatatttatcctgaaaatctcaagtcaattttaatctttgacttagcactaaggttgtaatttctgaatgattgaataagtcaccttgtgtccattctctgatttaaacgtaactgaatcagatttgttcttttaaactgggtgaaacaaagtaaaatgattagaaataagaacaaaggcataaaaataggacataatgcatatctttccactaaggaagtagatttatgtatctgtcttcttcattggactgaggttacttctaagaaccttttaattcagttctgactctccaatgccttctaaagcatctggtgagtaaataaaataagtgaataaaaaagaagaaaaaatataaaaagagacacttttttttttacaaagagaataattgaatatataaatcaacatatgagcaagagtgttgacatgtttccatcttaaaaaaagtgaaattttctttctcttttgatattgcttattactttgagactgttagttcaaatcaagtttacaatgtcttttcttcaactttctattttattttgacttgaattgctttctgctgaggtctattcttctaaaaccatttgggtagataagagatgctgtcatatttactaaatatctaattaccctattctaagagttttctggaaaacaaatgttgctgtgaaaatcattgctgtttgggctgttgtacatttaaacaatctatgaataatctatgcaaatacaaatggcaaggtaattacagaaagtattttttgagagctactatgtgccaaacatttccagagtcttattgtatttaattctcagagcagtcctgaaaggtgctttacagattaggacactaatatagaaagaaaataagacctttcccaaagaaggggaaaaaaaatcataggtttaattctacagcccagatacctattatgagacatctttatggctggcattcttgacctgattcgatgacagagctccaggggattaatttaaagattaagaccttagtctttaggaagaaagtgtttttgaatattttgtattttccccttcaccctcacactgcagtgatgattaatgagataagaggaagaacttgctactgtgactggtggctctcacagacacacatttgcttctatcctgaatatgaaggaaagtctctagagtaatcagatcaacattggaaatgaatgaagaaaagtttcaagcttcaaattcattgtgatttcctagccagaggggctaggaaggtattagcattttacagaaaactagtttacataaaaccaaagaaaaataatatttcaaaaaagggagaaaatggagttcccatcatggaacagcagaaatggatctgactagtaaccttgaggttgcaggttcaatctctggcctcgctcagtgggttaaggatctggcattcccgtgagctgtggtgtaggttgcagatgcagctcggttctggtgttgctgtggctgtgacataggccagcagctgtagctctgattagacctcctagcctcagaatctccaaatactacaggtgtagccctaaaaagcaaaaaaaaaaaaaaaaaaaaaaaaaaaaaaaaaaaaagggaggaagcattacatatcaacaatacaagtcatgttttgacaccactatgataaacattacttacaaaatactgaattcactttaaaaactactgaaacttccaccatattttaaaacaaaccaaactgagtgaaagtaacagagctatttgggctagttcattttcattgcaacatttgggtcaatagcactgatctaagtgcccttatttattttcacatgcagaaaaatacaaagaaatattgaatggcatgctgctatgcaatagctagtttctagaacaataaaaggcaattctacttaattacaatcgtataggttgctatcaataaagttataatattacttactaattttctggtaagagcaacttacttggaatttttttttctgccaagtattttcagatatggaaatattccaattagtaaaagcaaacagcagacataaaatatatacttcactttaaaattagaaaaaaatggagtttccgtcgtgatgaagtggttaacgaatctgactaggaaccatgaggttgcgggtttgatccctgcccttgctcagtgggttaacgatccagcgttgccctgagctgtggtgtaggtcacagatgcggctcggatcctgcgttgctgtggctctggtgtaggctggcagctacagctccgattcaacccctagcctgagaacctccatatgccacaggagtagcccaagaaatggcaaaaagacaaaaaaaaaagttagaaaaaattatacaattactctagatagatttaatattcctatttttctttaaaagattatacccattgtgtagactgattattaatcccccataaatgtataaatctctctttctgtgtggatgtgtatatgtgtttgtggtggagaatatagtctatctgattttctgttgctagtagtatacattacttcttttattacagacaaagcaaggtttatcattcaggagagcaagaaacttccaaaccaaccacatagcgagtaatttgagaataagctgtattttaaaaattggatgttctaattggagagataatggcctatcattataagacatacatctcagggccttggtgttgagctctacacccaaattcaaggcatgcctcattgtaattccttctggaagaaagatgtccaggagccatcttcctattgttgaaggataatgggaaatggacagttttttggccatgagccactatcatttaaataattggtggtttatttgggaaaaaactcagatatatttgaattccaaggtttaaataatctattggaatacaaagggtagacattaaaggtagaaaattgaagaattcactattttgaaatttgataggtgtataaaaattctattcaaccgctagaaaatggtaccctctcactttcaccaatgtctcaactaaattattcatgtcattttatgaaggctgatggattcccataaattcatacttaaaaaataatgagttccttcctggaagtaaatatatgcagacttccatcccagagttatctcaatttaaaaaaataagcaaataagtataataaaaatgtgagattgttttttaatagacatgctcttatgggctgaattgtgcccttcaaaattcatatgtcgaagtcctgccacctaatacttcagaatgtgactgtatgtggagatagggtctctaaaaaggtggctaaggtaaaacgaggtcatattgacaggcctaaattcagtgtaacttgtatctttaaaaaaaagaagagattaggtcatgatacagagagaagaccatgtgaaaacagttaaagtagatgtctatttataaatcaaggagggaggatctcagaagaaaccaaccctgtccccaccttgatctcagacctctaggtcctcgaactgtgagaaaaaatttctgttgtttaagtctttcaatctgttgtacttagttatggcaggcctagaagatgaatattcatgccatcctaattttaatagttttattttgatttattttagacttgtttatataaggcaacatgcattttttatgcaagatagtctaaggtgtcataaataaattccatcctttttttcatgtgcttacctctgttcaaaaaatgccagtaagattagtatcacttgtt

SEQ ID NO: 83 - DNA, 7826 bp, Artificial
  ss646 sequence
  misc_feature (2118)..(2118): n is a, c, g, or t
  misc_feature (2478)..(2577): n is a, c, g, or t
  misc_feature (4692)..(4791): n is a, c, g, or t
atgggaaacactttctccactcctctgggaacatgcttcttggctgcctcttatgaaattcagatactctcaactaagaggagacattaggtccaagcatcttaaattcttttgtaacactgcctggcacagtatacattggataatgggtctcaatggctcagaaacggcactttcaattttaatatattgcatgacctgggtaactcttgtccccataatgggaaatgacccaaaattccttacattcaggccttctttaccctctgctcctgaccctccctctgtttgtcttgctcgacccttcaaattcttcttcattccaaagacttacaactgcctccctctgattctgatatctcctcatctgaccctatggctcctcctcttccactgtataacccaaccgtctccatgctgccagatctcccatcaactcacagtcatcctctcttccaccctcagcttcctcagctcctcccagtgggtcctaatccagatcccaacccctctttcttccctccttatacatggtcctggacccaacctcctgcctacaaagacacctctcaaccggctcctttaggggaagtggcaggacctgaagggatcgttgggtccaggtccctttttctatgtccgacctctcaaattgaaaaaagattaggctccttctcttctgacccctccacctacattaaggaattggaatatctccctcagtcctatgaccttacctgaaactacatctatatcatcttatcctctcccctctcccctgaggaaaaggaaagggtttggttagctgctaggcccacgctgatgacctccactggcaagataatcaccagccggttgaagctgcagcagttcccagacagcatcaagtctgggactataaggtagattcctcaagccagagacgctggagttacagggtaacttgcctcatagcagaactctggaaagcagcatacaaagctgctaactatgaaaaattaaaggaaattagtcaaggtgcagatgaaaacatttccctctttctttcttgcttaatggagcttctctgaaaatatacaaatttagactcttcctcagcagaaggaagtcttttcttcaatacttcgtctctcaatctgcacctgacataaggcaaaaactacaaaaactggaggatggccctcaaactccacaatgggatctcttgagcctcaccttcaaggtatttgataatcaaatgaagaggctgaaagccaaaaattaaaaagagatcaggctaaataccaaatgctggcaactgccattcagggctcccaaagatataggctccctcacaaggacaatagcctcaaggcccgtccaggccaacattacaggtgaggcaagggaggccactgggcaaaatctgccctgaaattcactctctcccaggtaagtgtccctagtgtagcaagagaagccactagaaggtcaaatgccacaacccccctcagggagggccacctccctccctgcagagagactggagtcatcaaacctcgacttgctgagcctccttggcctgaccacagaagactgagggtgcccaggctggccccctgcccccaagcctatcactccatcagagcccagggtaactctgctggtggcaaataagggaccttttatcttattgacacaggggctacttatttggcactgccggaattcgtaggcccaacttacccctctcaagtctctttgtgggagctgatagcctaatctccaaatacttaacaacaccccctctaagttgcaccttatcaggaatacccttcagccattctttctcgatcatacccaagtgcccagccctgggcagagatattttatctaaattcagagcctcccataagcttttcactcctatctctgttgctgacccctctctccccatccttcttactcatccagaacctgataaaatacctctcccagtctccattctctcacccatggtatggaatacctccatctctcccatatctcagcatcatgctcccattcaaattatggtaaaagacccatccacgtacccctgccaaccccaatatcctttgtcccttgagagcagaaggngcctccaacctattattgactgccttctttcttataactcactctgacccactcactccccattcagcactccagtcctacaggtaaaaaatcagatggttctaaccgccttgtccaagatctccacgttataaacagagagtccttccactcacttggtacttcctaaaccctacaccatcctagttcttattctcccagaaccttttcattgaatttgatctgaaggctgccttctttactatccctttacacccagactctcaggacattttcaccttcacctggacagatccacacaccaccaattgagtcagcttacctggacgatccttccccaggatttttgggacagctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggaaccagaatatttcctactgcaaccacacaacctcactcaatgccactataggtacctggatgcctatagatccccatatgcttagcggttgacataatgtaacatttcaatggggaaattttctaaactacatccaaaaaacttatgaacataatatttctatctttaaaaatctcacgttctaccctttgggctaactgatggaacaggataaactctcagtaaactcatggctaatggaacttttaccgcagctggcccccaaaacgacctcattcatcttttattctgaaatctgctttgtcagcaatctccaagagtagagataaaaagacaacaagaaaaaaaaaaaaaagcaaaaaaaagcagggagcccccatacagtcctatatccagaccaatattttgcaggagatcacagatacaatacctccactgccaccactacagccctctctttattaggaacaggacacttcttcttatgtggcagtatggtctgcttaatacttctaagacactggtcaggtattgtactatagctgcgctaatgcccaatgctcaaatcctgtagcctcatgaaaaggctgcttcagatttaatttctaatctagggtcatttgtagcacatgctctaataagaccaaggttcaaaataaagacaagggaagtaagtccacccaaacttggcaatcatgcccatgacaaccctattttagaaaagccagggataggccactccatacagtgaggcctcttctggtttgctgggattctcttactagaaagatctatctggaacatctctctaactttaccacagtcctggaatgccacagggaaggcatttgaagaccaacggtaatctcttaatagcctagtagtcctacaaaagccttaatggcctagtgtggtctagaccttctaactgctgaagcaggaggcacttgtgccattcttaatgaaatatgctgcttttatatcaatactacaggacaggtagaagaaaatctaaaagttttaaaagataacatagaaataatacagaaggcaagaaaacacattgccttagaaaccttctggttgggatttctatttgcctcaatttcctcctcttttaaagctatatttcttctcttcataactccttttataattcttctcttaatatcactccttgtataatacgtctcctagtcaatttcatatggaaaacaatcccgatcgtagtcaacagagctaccagagaaatgttcctccttcagcagtaccagtaccaaccaatacacaaaaccccctgttttatcttatttttcttttttcccatcctccatagtaagaatttaccatgtccagctacccagtactagttgcctatagccagcagaatgtagctacggaagaggggaccattgctcctatcccatataaccaaagactggaatgataggtcttttgtcaccaggaggatagtagcagaccctctaccccctgaatgtggctgttcaccttggagatctgctgcagacatgcgtacggcccagcacaagatctacaccctttcccagaatgtgggtgctcaagttgggcagcaaaaaaagtggcctctcagaaaaaactgcctgcatagattaacctcctacaaggattaactgccctctctgatgggacttgactccctatccctcccctgactttcccctcctccttcatttttcctgccacaatttcccactaaaaactcccaccacagattcctaccatagatcttttataagcctaacatctcctcaaaggcgctggcaccatcttgagctcagcctctcccccttggatgccttaataaatctctcttgctttaccaacttggccttgcatgttcctcccttggcaaacttaacaataatattttaaatatgcatattatggaaaaatataaactcttaaatgcttttctgaattagctctgaggggtaagtggcactaagctaagcactatttctctataagtaataaactctctgaaataaaaatatctcccataatccagaggaaaggagaagtgaaaattgatattctaaatcatctgcaaaaatgcctagtctgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagaactagtttccattttaataaaaataaagacttttttatttccagttatattcccataagcatagcaattttaactatgatcctaaaatatatatgttatgcatcatacatgttaaattctagaatggatctttctataagatttcttttattaaattaaagtatggttgatttacaatatttcttcaatttctgttgtatagcaaagtgacgaagtcatatacgattccctgtggtgtacagaaggattccattagcccattctttataagatttcttttaaaaatttaaaacattagtgacagaaaagaagattttgtgtcccctaacaaactgataaactttctcctttctgaaagctggaacgatgcaatggatcacaatttcctttctggccctggattcatatgttaatctcactatttcttaatcctgatttcctatttcttttttcttaaacccatgtccatataatttaatgtaaacaatttcctttttttgaaaaataagttgtatgttattaaagtgttttatagttactatcaattcaatcatatgggtttctagtatttccaggaaaatttcaaggtttttcagacattttcaagaagaacctactcctggagttcctgtcatggtacagtggttaatgaatccaactaggaaccataaggttgcgggttcgatccctggcctcgctcagtgcattaaggatccagagttgctgtgtcggtcacagatgcagctcggatcccacatttctgtggctctggcataggccagcagctacagctccgataaaacccctagcctgggaacctacatatgttgtggatgtggccctagaaaaaagcaaaaaaagaaaaaaaagaagaaaaaataaataaatttaaaaactttaaataaaccactgggggaagagggaagccatttgaaaaatgatacaatctcatcaatatttcattcttcatacaagaaaagcatcacatggagcaagtatttaagagagagaaagaaagaaaagaaaaaatataagtactaaaaacatggatgaatttcataatctaggtatgtagagaaagactttattaccatgattcaaaattcacatgcaataaaagaaaagcttgatatatttgagtgcattaaaaaaatgttcttggagttcccattgtggcttagctggttaaagacccaatgttgtctccatgaggatgcaggttctatcccagacttctgtaattgggtaaggatcaggcattactacaagctgcagtgtaggtcactgatgaggcttagatctggtgtggctgtggttgtggcgtgggcctcggcttgtaactttgattcagcacctagcccaggaacttccatatggcccaaatgcagccataaaaagaaaagaaagaggaaaaaaaaaatgtctggagacaaatggtaaattcgaagtaattgtttgcaacagtgtgacagatataaggctgatatatctaatatataaataattcttaaaaactgagagaaaaaaagaccagaaaccagtatgaaaaaataggcaataagacatgaattgaaaacacaaaaaacatttttatatttcacaaaaatatataaattatctttaagcataaaaaagttgctcaaactcactgtttttcaacaagagaaatgcaaatgaaaactacattgatgccatttttcacctatcaacttggcaaaaattttaaagtttaacaacacactttcacatgcatgttttcatatattgcctttaagaatgtaaacggtaagctccttatggaagggcatttaacagaactacacgtgtgtttaatttttgacccaactgccccacctctgggaatctcccatgtggatacaccctacaacaatacaaatattataaacaaggttattcagcacaacattttttttgtcattgcgaaatatagacactaaattccccaaacatatggagactgtgtatctaaactatgatatgtagacaaattagtatcctgcagatgttaaaaaaaaaaaaaaaaagagtgaggaagatggctactatgcacagataagcttaattttcagaaacattaaatgggggataaaaggaaatttacaaatggatctaggacttcctgtcatggtgcagtggttaacaaatctgactaggaaccatggggttgcaggttcgatccctggccttgctcagtgggttaaggatctggcattgtggtgagctgtggtgtgggtcacagacgtggcttggatcctgcgttgctgtggctgtggtgtaggctacagctctgattagacccctagcctgggaacctccatatgccatgggagtggctcaagaaaaggcaaaaagacaaaaaaattaaaaataaataaataaataaataaaaatggatctataatatgctatcttttgtataacaaagaatgggaagtgataaaataaacatatacattatttttaaaaagaaacacaggtagggtgagtcacaaagcagtgagattggtttcctgaaattgttagtgacaatgggtagaagaaagaagggatatgtctctggtatatgtttttgtgtagttttgacatttgaaactgtgctaatttttggtgttactccaaacaaataaaaccagaaaaattgggggaaaatataaaattcaatacaaacagaaaaaaatgaaatgaatttcagtgtattctttccaaacttttatttttagaatttaaaatacagaagaaatgtttagaacagtacaataagcacaggccttacttacattcactaactttttgttttgtcttgttttttgtcttttgtctttttagggccgcagccatggtatatggaggttcccaggctaggggtcaaatcggatctatagctgctggtccacaccacagccacagacacatgggatctgagccacgtctgtgacctacaccacagctcatggcaacgctggctccttagcccactgagcgaggccagggattgaacccttgtcctca

SEQ ID NO: 84 - DNA, 7949 bp, Artificial
  ss647 sequence
tgcttggggatgggggaggtccgggatgcttacatgggaaaatcacgaccttgtagtgtataaaagttactgagaacaaagagctggtgctcagactctggaggtgactcctctgagcccgcactggtgctgaataaaccttgcttttccatatctctgagtgctgtttgtctccttccgttgccacggtttttgcggtttccacaacatttttgtgcattggctgggaagccgacaacggagctggcctcttttgctaccattgtcagggaactgggggaggccacagtcgccagcccagtgacaggtggatagagcgcatcagccattttgccggatccagaccctcactcgggccgtggccttggcccacaccacttcccaaacagactcagaaggagagtggaaacaggttcctggacaggacgtcagactggtgagtgccccagggacatctgcccaagtcaggacccgccatacggcggaaggagagactgatcacctctcagtgaccaaagggtcactcaggtcagggtttgctcccttgggatcaggaggcttgtcaattctggtgtgtgtgtgtgtgtgtgtgtgtgtgtgtgtgtgtgtgtgtgtgagagagagagagagagagtgagtgactggagagaacaagagcccgtgctccaccgtctttggagtacggagccagagtgagtcctaacctgcagttccgtggcgaccctcatacggcttatggtggccctcttcgggggaacctgacgttggggtttatacagccccacctatgataagaggcgcctgaaatatctcctccgggggagtggtcagatggacgaagcgattgttacctgaggccttgtcctcacagtttgtcttgcgtcaccggcacggggtgggacttcacacaatgggtaaatcggcttccaagcccactatcttagagtatatgtttaagaattttaagaaaggttttctagagattatggtgttaagctgagtcctggaaaactgtgtaccctctgtaccctagagtggccctcctttggtattggctggcctccggaagggaccttagatgtgttcacagttacagcagtatataatgttataacaggagaccctggacacccagaccaatttctgcatattaatcaatggttggaaattgcctatttgaggtccccatgcgttcggttctgcaccacagaccagggacagtgtagggtgctagtagcccagtccaagaagaaaaccttgtctcaaaaaaaaggtgccacctatttatcaaggggaacctgaggactcaccccctatgccaccaccttatgtgctgctggccccacctccgggagccgaaggtccccagataccagatagcccactgccttctgtttctcctcctccttctgcttctgaagttcccgaggtgatatcacccctgcagccagattctccagaacctattagcaggcatctccagtcagctcagggagcagccactccagcattacaaatgcccttacaggagacacggggaccacagcaagtcgcccccgatgggaccatacaagaggggggacatttttattattaccagcccttttccactgctgatctcctcaactggaaacaccatactccctcatattctgaaaagcctcaggcactgattgatctcttagaattcattttccagacacactgtcccacctggatagactgccggcaactccttttcactctatttgacactgaagagcgctggcgaattgtaacagaagcccaaaaatggcttcaggccaatgcggggggtcaaacagacttggcaaactgggtgagggaagccttcccagaagaaaacccccactgggactatgacattgaagaagggaaatgtaacctagagaggtaccagcaggccttcctacagggggcaaaagctggagctaaaagccctactaatatagctaagatcagtgagatactgcaagagccgaatgaaagcccagccaaattctgtgaaagaccatgtgaagctttccaaagctacacactttttgattccaaggcccctgagaagcaacggatgataaatgctgcctttgtgggacaggcccaatcagatatccataaaaagctacagaaattagaaggatttgcaggagagaatgccactaaactgttggaaatagccaacaagttttttattaaccaagaccaagtggcccgccgtgatgcagaaaagagaataaaacaaaaagtgactcttccggcagctgccctgtcaaaaccggtgcccccagtgggaccaccccgtaagggacaaggcacaaggccagggaaaaggagtcccctggaacatgaccaatgagcttactgcaaaaaaaagggacattggaaaaatgaatgccccaaccgtcctgagaaaaagaccaaggccccacctagccagtaccgatctgagccattcagccccaacctgatcggcctagctgagtctgattggggggaccaggctctctccaactgggcccccgagagcctatggtcagaattcaagtaaggggccaccccatagactttatggttgacacaggtgccaaactttctgtggttacacaacctgtagctcccctctcggggaaagaaaccaccattgttggggccacaggtaaccaaacccacaggcccttcagcggtccttgacgatgtcggttaggaggccatgaagtaatacatgaatttctttacctgcctgactgcccagtccccctgatggaaagagaccttctggctaaaatgggggcacaaatttccttttctactgatggatcagcccaactcaaattgacagaacccccccctctcctttaatcatggctcttgctgtaaaaagagaagagaaatggcgcttgtactcttccccttcagaaatggggaccattcccccagaactagagactaaatacccattggtttgggctaaaggaaacccaccaggactggcaaaatgccatgttcctgtcttgattgatctaaaacccggagttcaactggtaaagctacgacaatactcaattcccagagaagcttgactgggaatccaggttcacctggataggctgcttcagcatggactgttaataaaatgtcagtccccttggaacacccctttactgcccatgaaaaaaccggaaacacaggactaccgcccagtacaggacttgagagccataaataaaaaaatagtcacattatacccgtccatccctaacccgtataccctgctagggctgatcccctccactgctgagtggtttacttgcctggacttaaaagacacctttttctgcctccgggtggcacctgccagtcagcccttgtttgcttttgaatgggaaaatccacatagagggacaaaggaacagctcacctggacaagactcccacaagggttcaaaaactcaaccactctttttagcggcgccttagctgctgacctggctgaatttcctggacaaaaactgggctgtgttttgctacagtatgttgatgacctcttactagctggcatcaaggaggctcagtgcctagagggaacaagaattctcctttccctactgatggaggcagggtatccggtatcaaagaaaaaggcacaaatctgtaaaaaacaagtcaagtatctgggcttcaatatcatgcagggccgacgaatgctggggactgaaaaaagcaggcagtttgtgccattcctgttcctaccacccgctggaaggttcatgagttcctaggggcagcaggattctgctggatatggatccccgggttttcagacttggtcaggcctctgtatgaggctctaaaaggggaagaaaaggctccccttaaatggggaccaagccaagagacagtgtttcagacaatcaaaacaaaactcactgaggctccagccttgggacttcctcatataaccagagaatttaacctttttgttcatgagaaaaatgggatggctttgggagtcttaactcaagaatttgggccttggcggagaccagtggcatatctgtctaaacaaattgactcagttgctgccagatggcctccctgcctctgagcgctggcagctaccaccttgttggtaagagaggctgacaagttgaccctgggacaaaacctcaatgttaaagtcccacactcagttgtaaccctaatggataccaggagccaccattggctcacacatgcacgaatgactcaatatcaagggttactatgtgaaaatccacgggtaaacctggaggttgtacgaactctgaacccagctacttttctgccagatgaagcgggacccccagaccataactgcctggaggtactagatgaggtgttttccagcagacctgacttgactgataaaccactccaaaatcctgacctggttttatatactgatgacaacagctttatggaggatgaaaaaaggaggacaggatatgctgtggtatctgacttaaaagtgataaaagcagaggtgcttcctcaaggctggtcagcacagagagcagaattatgggccttaatcagaacactggaactcagccgagaccagtgagttaatatctataccgactcacgatttgcctttgcaaccttacatgtccatggagccttatataaagaaagaggactcctcactgctaaaggaaaagggattaaaaaccaggctgaaatcttaaagcttctagagacagtatgggaacctaaagaagttgcagttatccactgtaaaggccaccaaacccagtgacaaaaggaaaccgtagtgctgatgcagctgccagacaggcagcccggggacaacagccagacaaacctaaggtcttgctggccccagaagtgccatctgtccccagatattttccaaaggaagaaaaatggataagggaggaaggaggaactaaaattaaaacgggatggtgggtcacacaggacctccgagtttatgttccagaacagctggcctacaaactagtccaccaacaacatgagctaacccacatgggcaaaactgccttagagaccctactgggctggtactatctcattgctcgtcttcctgcactctgctcctctgtctcccaaagatgcataacctgtttacagaataatgcccaccaggggccccacagaccagctggggcacaacactgtggactgtccccatttgatgatataaaagtggacttcactgaagtcacccctaatgaagggtacaaatatttactagtttttatctgtactttttcaggatgggtagaggccttccctacccgaactgaaaaggcaagggaagtaactaaggcactcctgagagacattattcccagatatgaaatgcctctgaccattgggtcagataatggactggcatttgtggccaaaacagtataacaggtggcaaaagctttacagatctgataaaaactacattctgcttatcaccctcaaagttcagggaaagtagaacacatgaaccaaacccttaaacagacactggcaaagctatgtcaggaaactggcttgccctggatagacatgttgctggtggcccccttaaaagtgagatgctcacctcgagtgggaataggattctcgccatttaaaaccttatatggaaggccacctccactaatcagtttaaaaggaaacaccagggagttgcgagacttggaattacataaacaattacaaggactggggctcactatttcttggttatataaatgggtcacagacagaatacctgtgtccttaggtataacagtacacccccacaagcagggggaccaggtgtggacaaaggactggaaaaaggagtctttgaggctggtatggaagagcccctatactgtaatactaaccacccccactgctcttaaagtaacaggaatagatgcttggatccatcattatagagttaaaccggctggcccagctgatgaccgtggagagtgggagactgccctcgatccagagagacctctttgcctgacaatacagagaaggagacaacaatctcaaagccctgctctgaccacaccagaagctggtcagtcaacgcatggctgaagcttgagaaatcagctgcctgtgagcccaaatggaaggagggtttcaaaataagcattcgcattgacgaaagaggccttgaccctggagctgtactacatttccagaaaatcacgtttgcgctccaagctgcctctcacagggtctttcattccttttatgaagagataaaaaacaccccacctcccattctggtcacaactaagaacttgttcttagccctagcaaaaactattgcacaaactctcaaggtctcctcttgttatgtatgcgggggaacgaacacaggagaccactggccttggcaagccagagaaatggacccattagagcctcataatgagactgcatacccccaactcactgatggggtatggctcctcaaaactgccattatagggaaaaattgtcttgcgaggcggggaggacagtttaatgtttcagttgaaagcctaacatgtttaggcctaaggtattataatctgactgcccaaaagactcaatggtggtcatccttcaatctctcagagccgaagcctaatcccttgtctaacttttccctccttcgacaagcatggaaagatataatatccagtggcaggcaccaaagggagtatattgaatttgtggaaaaatggcctattccatactccccccaaattgggctggggcatgtgtactgggaacaatcagaccttccttcttcctgctcccgctgtcactaggggagcaactgggaattcctatatatagggcacagggtgcccagagagaccggagggctctccaaattggagactggaaagatgatgaatggcccccaggatggataattcaatattatgggcctgccacctgggcagaggatggctcacacccctatctatatgctgaactgcatcatcagactacaggcggttttggaacttataacaaatgacactgcaagggccttgactatattggcccaacaacaaactaaaatgaacagtacagtctaccaaaatcacttggccttggattatttacttgcttctgaaggaggggtttgtgaaaattttaacttaagtaattgctgtctacaaatagatgacactggaaaggtggtagaagaaattgctgaccacaagactaaacttgcccatgtacctgtacaaacttggaaaggatgggatacagacagtctctttggtaaatggttctcttggttgggagaaattaagacaatggttgaaataatcatggttatactcacagggtgcctacttgttccctgccttgtaactctcctgataaatattataaaaggttttataaaaagcatggttaaaaaaaaaaacagcctcccacctgctacttatcagaggctaccaaagggttatgactgatgatgatctataaagggtgcagatgcaccctaaacatcaagaggggggaatgaaatggagttttaactaaaaaacaatccccccccttggctaagaaggcagctgcaagcctttccagctttgctcatcactatgccacccttcttgtaataatgtaacaactgtgtgccctctgtccaagccagcagccttgctaaccaggtacccagcattgcttatcagttccacttctgcaaccttggttgctcagtttcttggggaggaacactgtctgcttggggatgggggaggtccgggatgcttacatgggaaaatcaagaccttgtagtgtataaaagttactgagaacaaagacctggtgctcagactctagaggtgactcctctgagcccgcaccggtgctgaataaaccttgcttttcca

SEQ ID NO: 85 - DNA, 3901 bp, Artificial
  ss650 sequence
gttagtttaactgttaaggaaatccaaaatttttcagaaccatataggttggcaaattgcctttgcagattatgtaggatcaatagataatcattatccaaaaaaaaactctattttacaatttataaagcgaactcaatggattcttctaaaaaaggtgaaggcttcacccatcattgaagcccctgtgatctttactgatgggactagtaaagggaaggccagatatgtggctaatcaatataaaattacagaagtgcctggcctttctgcccaacaggctgaactaactgctgtaatccatgccttgagggactattctgagcctatcaatattctttctgattcggcatatatagttcatgctgccaaaatgattgaaacttctaccattaaacaaaattaacctatcttgctatttgacttgtttacagaattacaaactgttttaagggaaagaagatatccattttatattactcatatcagagcacatactaatctacctgggcctctagttgcaggaaataaagaaatcgattgcttggtaacacctgcattacaagaagctcaacattttcatgatttaacacatgtaagtgttcaagcccttaaaaagagatttggaataacatgggctaaagctaggataatcgtctgtcaatgtcctgcatgtcaaattattaacaattcttctcaatctgagcctggagttaaccctaggggacttgtcccaaatgctctctggcaaatggatgttactcattattcatcttttggaaaattgtcatttattcatgtatgtattgacacttgctctaaatttatttgggctactgagcaatctggtgaatctgctaaacatgttatttgtcatttatatgcttgttttgcagttataggcgtgccacaagaaattaaaactgataatggtccagcttatatcagttctcaacttaaaacattcctggaaacatggcatattgttctctccactggtctccattacaacccccaaggataggctattgtggaacgagccaatttatatgtaaaacagactcttcagaaaccaaaagggggagacacagaaatagttaagtcacaacaaacacttttaaataaaaccttattcactttaaattttttaaatttggcctctgataaaaaaatggctgcagagagacattttaatacagaacaaaataagattaactttcctcaggttgaacagcccttgatttggtggcaggatccattaacaaatttctgattcccgggaaaacttattatgtggggtaggggatatgcttgtatttttaccaggtcatggattacaatctgtttggattccatcaagaagaatcaagccacatcatgagcaagcccatgaagcatccctcgactccaaaccccagagggaggatgataagtgttcatcttcccacttggggtcagttcaaacatctaacccaagaagatgaaaatctactgagaagagaagaaaagcctctcactctaaataatttggtcttaactgtctttccattggtttctatctcagtgagtattcccttagcagctgcaagagaaactaattatacctactgggcctatatccccaatcctcctttattgagacctgtggaatgggtgaggctccagtgcatatatatattacctattaatgatttatcttgggtccctgggctggaggatgatggacagcactattttgaaaaggaagaagggatgactttctatcaaattttaaagtttaaaaattggctgatttgcattggaaaagaaaacttatgtttaactcctgaatctcaaatatggttttcaggaaattaagatatgcccactagtgaagatgtacatttagttacaggctggagttttgactaccatcaggtggaaccagttaatatgggatgtctgacaggactttatgtaccttcgagagattgaaaaatcaaattcattagaatatatgcagggctatggaaggggtcatactgcttaatggttcctgtggaactgtatgggattggtcccctaaggggaagccaattcctgtctgtatgggccatcaacctctgtgttctgttaatgaattattctcttggacagtctccagccaatcaggccaacaagaataaaaaaataaaaaaataaaaaaataaatagaaaaaatagaaaaaaaagaaaaaaaaaatatatataaagtctttgaaactgctcaaatcaaagctggggcagatgaagagaatgatactataaatgccagaggcaaattagaagagagagaacaagattccccacagggtatcaggtggtttctatgagtgatcccagttggtctgttgatgagggagataaccacaattggcatataaatcattttgttacttgtatagtagagggattaaaagcctcacgagtaaagcccattaaaaactattggaggtttagtaggggaataagagagtccatcaactttcttagaaagactcagaaaggcattgagaaaacatatgccaaggaacccagaaacaatgaagggccaaataattcttaaggataaattcatagctcaatcggtgacagatatatggagaaagctccaaaaaattggcttttggccctgatcagaacctggagcacctcctcagagtagcaactccaatatgttataattggggccaggaagaatgaaaggagaacaagaagagaggcagagaaaaggctgaggctctagttacagtgctgcagggagtcaatctggaagtttccaacgtcagaggactagggcagagacttatgcccggagcctgtttcctctgtggaaaagagggatcctttaaatgggaatgcccttagactcagctgtgccccatatgttggggagatcactggaagtgggattgcccctgaagatgaaggtctctgtggttgacccctcaggcccaggatcaagactgatgggacatttccataatggctcctgtccttatcaccactcaggagccctgagtgactctaagtgtaggaagacagcctattgacttcctcctgaatacgggagccacttttcagtcctcctctccaatcctgggcccctccctcatgaatctgcgacgttcatgcttctggcaagctggttacaaaatatttacacaacctttgagttgtgactgggaatccattttcttttcttgatgcctttctgattgttccagagtccaactcctcttttagaaagagatattttgtaagaggttaaagcctcaattcacatggcaatggaggacttcccatgtggctcacaacataactattcggcaatccctcacattttatttatgtgcagtatgttaactatgagcaaaatgatagtgtatgtcagtcaaatataaagcttttcttttattagtattaaaacccggtgattaatgcagaagctcatggaaagtagcaggttaatctgaacaatatatcatttcctttcagttcccaatctgttatttcacagaccatggttaatagaatgtcccccaaaataaaaaaaaaattaaaaaataaaaaaataaaaaaaagaggagctcctgttgtggcacagtggttaacaaatccgactaggaaccatgaggttgcgggttcgatctctgcccttgctcagtgggttaacgatccggcattgccgtgagctgtggtgtaggttgcagacatggctcggatcccgcgttgctgtggctcaggcataggccagcagctacagctccaattcgacccctcgcctgggaacctccatatgccgtgggagcggcccaagaaatggcaaaaagacaaaaaaaaaaaaaaaaaaaaaaaaaagagagagaggggtgaatatatg

SEQ ID NO: 86 - DNA, 5200 bp, Artificial
  ss668 sequence
tggcgcccagtgtgggtctggaagagaaggtctgctacaagcagagaaagtgaaactacagatggcagagacagtagccttgcacttcacagagtctgggctgtgagttggcaagtagaaactttaaaccaggataacaatggggcagaatcaatcacaggaaactaaacagtatattcaattgcttaaatgtatgaaacgactcaggtaacagagtctaagaggaattgttagaagccgtgatcaaatataactctagattttcaggcaagggtactgtggacccagaatgttgggatctcgtgggagaacatttaaagcgcgcccatcagtcttgggcttctctgtttctattttttctatgtggggactagtaagacaggttttggaacacttatgggagcataaaggaaagcctatgtgttctgttcctcctcagattgatccctttcttgatgagagtttaaataagtctttagctgtggaagcaacactaactccccttcaatcagccttaaaatctgctagtctggaggatcagacatttttagcatgcactataactactgcccctgatccttaagtcccaggacaaaatatccacacacataaaacccttttgattttaaagctcttaaagctcttcaggagagtgtaatacagaatggagttacagctccttttattatgattatggtggaaagcatggggacacttcaacttcccccatggaattggcatatgatagccaaagccaccttagatggtggagactatttaatttggaagtctagtctttcagatttttgtcaggtacaggcttgcttaaatcaaagaaataatgttcaattacttttgaaatgttggctgggacaggcccttgtcttaacttagcaaaccaaatgacttaggatccttgggcgtatgagcagttgagtcccaaagattgtggatgacaattcctgagagaggaaatccacaaggatcttttgtacaatgccttcaaggccctacagaaccttacccacaatttgtggactgcctaacttgagtagtacatctgtcgccaagtagcacattctcaggcggctgatattttaattaaatgatggcatatgaaaatgcaaataaagactgtaaaagggcaatggcccctgtaaaaaatttagggggcatctatgattttattaaggtgtgtcaagatttagggagtacagatcatactcaagcaatgctagctgtagcattgaaaggaacatttggcagctcaggaaagaaatttttttttttttttgtcttttttttgctatttcttgggctgctcccgtggcatatggaggttcccaggctaggggtctaataggagctacagctgccagcctaccccacaggcacagcaacaccagatccgagccgcatctgcgacctacaccacagctcacagcaatgccagatccttaacccactgagcaagggcagggatcaaacccgcaacctcatggttcctagtcggattcgttaaccactgtgccacgatgggaactccaaagaaatgttttaactgtggaaaggcaggacacttcagagacaatgctgagcccactaaaaagaaaaggcacaccccgccacaggatcatctccaggatctagtcataaccctggtttatgtccttgtcagaaaggagatcattgggctaatcaatgtcggtctaagtttcaccaaaatggcaccctgcttagacagctttggtgttaggaaatgggaatcggggcctgcctggtcccatcaaatgatgagggcatttgtggctcaaacagaaaaggaatccaatcccctacaagggccactcctggcagcacaggggtgaatttaccctgtgccacagcagcagttttaacatataaacagggcattcaggatatccctactggaatttacggccctcttcctcctgatactgtaggcctcattatagggaaaagtggcttaaccatgaaaggcttacaagttttgcctggagtgattgatgaggactatcagggagaaattaaggtgatggcaacgtcagataccattcatattatatacagccaggaatgagaattgctcaattgttactgctgccatattttaagataggaaagaaagagttgccagaatgaaaggggaacatcaggatttggaagttcagggacttctcaagtgttttggactcaggaagtcacaactgaatgtccacaaatgactattaaggttaatggaaaaaatataggaggattaacagatactggagccaatgtttcagttatttgttacagtgattggcatcccacatggcctttaattacccccaaaaacgaagttgaggggattaggagttctgactagagtccatcaaagtcagcagatgctttcctgggtcagaccagaggggaaaacaggttattttaaaccttatgttgctgatatacccatcacttcatggagaagagatcgtccatctgcaatgagacttaaattaacaactgaggatgtctattgtggtgattctaataattcttcccctggatggaaactaatgaaaaaaaattaggatatctaaaacaaacaggtttaggaaaaaataatcaaggcataaaagaacctataaacttgcccattaagcttgataaacatggaatagggttccatgaggatttttaatatgggccattgaaaagtctctgctagcccatgcagatcctatacaatggattaacgatgatccaatttgtgtagatcaatggcccctaactcaggagaaactgactaaaatgcatgagctaatagctcagcaattacaagcaggacatattaaggaaattaacaacccatggaatactcctattttttagtatccctaaaaaatcaggtaaatggagactactacatgatttaagagaaattagtaaaacaatgtacgctatgggggccttacaaccaggcttgccttctcctactgcaattcccttagattgagccttaattgttatagatttaaatgaatggttttttcaccataccattagtccctcaagataaatgtagacttgtgttctctgttcttgctttaaataacaaagcgcctatgaaatgatatcaatggaaagtattgccacagggcatgaaaaacagccttcccttaagccaaaaatttgtggatcaagccttcactcctgttagatttaaatatcctgaggcatatattatgatattctcctctctgcttcaaaagaacaagtttttaccatcttgccggatattgaaatatatcttaataaaaaggggcttattatagccccagataaaattcaaaaaaccactccatttcaatatttaggaactttaatagaaggtcgtactatttggccacagaaaatggaaatttgtagggaccaatttaatacattaaatgattttcaaaaattattgggagatattaattggctacagccttatttaggaattgctacaaatcaattgactcatatttttaaaacattgaagggcaatcctgaccttacctccccacatacattgactcctgcaactctcaaagaattaggcacagttgtaatgtattgattatgataatcctattattctgattgtgtttccttccataaattcacctacagcagtcctggttcaagaaattccaccgtttggcattgttgaatggatccatctttcttttttttttttttttgtcttttttttgttgttgttgttgttattgttgttgttgctatttcttgggccgctcccgcggcatatggaggttcccaggctgggggttgaatcggagctgtagccacctgcctacgccagagccacagcaacacgggattcgagctgcgtctgcaacctacaccacagctcagggcaacgctggatccttaacccactgagcaaggccagggaccgaacccgcaacctcatggttcctagtcggattcgttaaccactgcgccacgacgggaactccggatccatctttctaattaagaagtaaaaacggcaacactctatgtagacctcatagctaagattattatccaaggcagatgctgtcttaaacaattgattggagtagatccaaatgttatacatgtccctctagacaaattcatgagagaaactttattccgaacctcattgccatggcagaaatgctttagctggataaacaggagaacttgataatcatccacccaaaaataaacttataaaatttctacaagagacctcttttatatttccaaaagttaccagatcacagcctattgctaaaaatcctacttattttatagacagatcttcaaatggtaaagctggtattcaaggtccaaatattactaaaattatacaaacctcttacacttcagctcaaaaagtggaactagtggctgttcaacaagttttaaaaataatcttgtatctttgtaatattgtttcagattctcaaaatgtggcacaattagtacaaaactagaagcagcaaaattgaaagaattaaatgatgaagagttatttcatcttttttttttttgcacacaacaaattattagacagaggacatcaccatttttaattactgatatacgttctcatacttctctgccaggtcctttacatgatggtaatcaaaaggtggaccagcttataacttctatttttgaaactgctagtgctttgcatgcatttctccatcaacccacagcaatgctgtgtagacagtttagtctgtctcacgctgttgtccaagatattgttaaatctgtccatcgtgtcaaagcttagcctaagtgtctaccaatgatggagtcaatcctagaggactgaaaattaatcaactatggcaaatggatgttacattaatagttttggtcgtttaaaattcgttcatgttattgttgacacatatttctttgttctttgggcttcagctcaggcaggtgagacttttcaacatgtcaaaaaccattgtttgtaagcttttgctatttgggccttccacagtgtattaaaacggataatggtcctgcttatgctagtaaggcttttgctgaattttgtcaagtgtggggtattttacatgtcactggcatcccttatcatccccaaggacaagctatagcagaacgtgcacatcataaa

SEQ ID NO: 87 - DNA, 6380 bp, Artificial
  ss669
caagcccaatcagacatccataaaaaaattacagaaattagaaggatttgcaggaaacgaacaccacagaattactagaaatagccaacaaagttttcattaactgtgaccaggtggcccgctgcaatgcagaaaagagaatgaaacaaaaagctgcgcttctggcggcagcccttttgaaaccggtacctccagagggaccagtccagaagttaaggggacaaggccgggaaaaaggagccgccttggacacgatcaatgtgcctactgtaaagagaaggaacactggaaaaatgaatgccccaaccgtcctgggagaaaggccaaaatggcacccccgcctagtcgacccatccagcgtgaatctaattggcttagctgaagcagtatctgccccagctctctccaaataggcccccgagggcttaaggtcagaattcaagtagggggccatccatagactttatggtaggtacaggtgctgaacattcggtggtcaggcaacccatggctcccctctcggggagagaaacaaccatcatccaggccacaggttcccaaaccctcaggtccttttgtggtccccgatggtgctggttaggaggccaggaggtagtgcatgaatttctttacctgcctgactgcccagttcccttgatgggaagagacctgctggccaaggtgagggctcaaatctccttctctgccgaccaatcagctcaactctaattaacagaaccaccctctcctttaatcatggctctgcctgtactcttctccttcagaagaggggatcattcccccagaattagatactgagtacacattggtttgggctgaaagaaaccctctgggactagcaaggcgccatgctcctatcttgactgatctgatacctggagctcaactgataaagctgtgacagtacttgattcccagagaagctcgactgggaatccaggctcaccagacaggctacttgagcacagacttttgataaagtgttggtcaccctggaacatctccttattgcctgtgaagaaactggggacacaagactactgcctggcttaggacctgagggccataaatgaggcaacggtcacattgcacccctccctgaccaatatgtatactctgctggggctgatccctaccactactgggcagttcattttcttggacttaaaagatgccttctcctgcctccgagtggcacctgctagtcagttcttgtttgtctttgaatgggaaaacccacacactgggacaaaggagcagctcacttggacaagactcccacaaggattcaagaactctcctgctcttttcagtggtgccctggctgatgacctggctgaattttctggacgaaaactagactggatcttgctgcagtatgttgatgacctcttgctggccagcaccacataggctcaatgcctggaaggaacaaacgttcttctctccctacgaatggaggctgggtattgggtatcaaagaaaaaggtacagatctctaagaaacaagccaagtacctgggctttaacatcatgtggggccaaagaatgctggggactgaaagaaaacatgtagttagttccattgcagtccataccacctgctggaaggcacatgagttcctaggggcagcgggattctgcaggatatggatctccggattttcagacttggccagacctctgtatgaggccctaaaaggaggagaaaaggctccctttgaatggggaccaagccaggagatagcatttcaggcaatcaagaccaaactcaccatggctccagccttaggatttcccaatgtaaccggagaatttaacatctttgtttatgagaaaaatggaatggccctgggaatcctaacccaagaattcagaacttggcagaggccagtggcatatttgtctaagcaaactgactcagttgcagccagatggcctccctgtctctgagcgctggcagctaccacattgttggtaagagaggctgacaagttgactccgggacagaacctcaatgttaaagcccctcattcagttgtaaccctgatggacaattggggccaccactgactcacgcatgcactgatgactcaataccaagggttactatgtgaaaatccacgggtaaagctagaagttgtacaaaccctgaacccagccaccttcctaccagatgaaaagcagcccccagaccataactgcttagaagtactagacgaagtgttttccagcaggcctggcttaactgacagaccactccaaaatccagacctggttctgtatacttatgtcagtagcttcatggaagatgggaaaaggatggcaggatatgttgtggtatctcagaagggatggaagcggaagcgcttcctcaaatttggtcagaacagagagcagaattatgggcattaatcagagcactagagctgagcccagaccagcaagttaatatctatactgaatcacaatatgcctttgcaactctacatgtccatggagtcttatataaggagagaggactccttcctgctgaaggaaaagtgatcacaaacaaggctgaaatcttaaagctcctagaagcagtatgggagcctaaagaagtagcagttatccactgcaaaggctaccaaaagggaggcgacctggtggcaaaagaggaaatggcagtgctgatgcagccgccagacaagcagcccaggggcaaccgccagacaaacccaagtgccgactgtcctcaagtactctccagaagaagaaaaatggataaaagagggaggaaccaaaactaagatgagatgttgtgtcacacaggactgcagggtttatgttccagaacagctagcctacaaactagtccaccagcaacatgagttaacccacatgggcaaaacagccttagagacctcaatgggtcggtactaccccattgcacctcttcctgcactttgctcctctgtcttccaatggtccataacttgtttgcaaaatattgcttcccaggggcctaacagaccagcagggacacaatactggggactgtccccatttgaggatatgaaagtagacttcactgaagtcaccctgagcaggggataaaaatatctgctagtttttgtttgcaccttttcaggatgggtagaagccttccccaacctgaattgaaaaggcaagggaagtaaccaaggctctcctgagagacgtcattcccagatatggaatgcctctgagcactgggtcagacattggaatggcatttgtagccaagacagtgcagcaggtggtgaaagccttacagatctgatggaagctacattgggcctatcaatctcaaagctcagggaaagtagaatgcatgaactgaaggctctagtgaagttatgtcaggagaccagcttgccctgggcagatatgttgctagtggccgtcctaaaattgagacgctcaccccaagcggaaataggattctcaccatttgaaatcttatatggaaggctgcctccactgatcagtttgagaggaaacaccagagaattggaagacttagatttacataaacaactgcaaggattgaggctcactatctcacaaatacacaaatgggtcacagaaagaatacctgtatctctaggcataacagagcacccccacaaaccaggggacaaggtgtggataaaggactggaaaaaggagcctttaaagccagtatggaaagggccctatactgtaatcttaaccacccccactgctctcaaagcaacaggaatagacacctggatccatcactccagagttggcccaactgatgactggggagaatggagagctgcccttgatcccaagaaacctctacacctgacaatacagaggagacaatgatcttagaaccctgctctgaccacaatggaagctggtcagtcaatgcacggttgaagcttgaggaatcagctccctggtgatgattgttgtttgctgttattaatctggtcccccttgaccctgtcaggatctattctgatgggtgtagaggcaccctgaacatcaagagggggggaatgaagtaagagttttaactatagaaataaaccctcctccctgctgaggaggcagctacgtgctagacagcagctttgcttgcctcataccacccttcttgtaatcttgtagcaaaaacgtgccttatgtccttgctagcagctctgctagccatgctccaagcattgcttatcagttttgttttcatttttgtttacttagcttcttaggcaggaacactgtttcgggaaggtggtggggcaggctccttacacaggaaaaacgagacccggaagtctgtactgtataaaacctacctagaacaaagacctggtgttcaaattctggaggcgactaccctgagcctgtgccagtgctgaataaagctggctattccccatctctgagtgctacttgtctctttccactgcatggtttctgcaacattttgaatcaagatgtaaaggtaagtcaatggagaaatgatagtctcttcaacaaatggtactagaacaattagacatccatgggcaaaaaaaaaaaaaaaaaaaaaaaaaaaaaaaaatcttgaaccctacctcatatcatgcacagaaattaatttgaaattaatcatagaccacaatgtaaaacctaaaattataaaagttgtggaagtaagcaaacaaaattcttagtgactttaattaggtaaagatttcttcaataaaactcaaaaatctggagttcctgctgtggcacagagggttaatgatctggctcctatctgtgtttcaatccccagactgagcacagtggattaaagatctggtgttgtctcagctatggctcagaacccctggccagggaacttccatatcctgcaggtgtggtgggaaaaaaaacacaaaaactctgaacattaaaagaaaaaattgataaaatgacgtttttaaaaatgaggagttgcctcgtagcctagtgggttaaagatctggtgttgctactgctgtagcttgggtcactactgttgcacaggtttgatgaatttccacatgccatgggtacagccaaaaaaaaaaaaacttctactctttgaaaaatattaagaacatcaacaataagtaactcatatactgggagaaaataattgtaagatacatatcttataaaggtcttgtatctgccaattaaaaaccttgtagatggtaaataagcataagaaaagatgctcaaaataaccagtttttaggtaaacacaaattaaaacttggatgaggtatcactatacttattataatagctaaaattaaaaaaatctgacaatatcaataggcagagaggatgtgaaatagctggaatctcacaaatttccagggagaatgtgaaatgaatgactttggaagggtctggcagtttttataaatataaacttttattgagcattcaactcagcaatcgtactcctggagaataagacaggtcaacacaaaggcctactacaaatgtttataacaagtttattcataattgccccaaactaggaactaaatgtccagataaataacttgtggtacatgtttactactcagtaataaaagggaactactaaggcatgcaactacatgggtgtatctcaaaatcattatgctaagtgaaagcggccaggcacaaaagaccgtattatttcatttatttatttatttatttattttttagcttcctttttttgtcttattttttttttttttttgctatttcttgggtccgcggcatatggaggttcccaggctaggggtctaatcggagccgtagccaccggcctacaccagagccacagcaacgcgggatccgagccgcgtctgcaacctacaccacagctcacggcaacgccggatcgttaacccactgagcaagggcagggaccgaacccacaacctcatggttcctagtcggattcgttaaccactgcgccacgacgggaactcctattatttcatttatatagttgtattaggcatctccagagaaacagaaccaataggagatatatacctatacaaaagagatttattatacaaaatgggttcatgtgatgatggaggctggaaactcccaagatgtgtagtcataaagctggagactcaggagtatgaatggtgtaaattccagtctgaaagccttgaaaggcttgagacccaagaaaagccaatgttgggagttcccgttgtggcgcagtggttaatgaatccgactaggaaccatgaggttgcgggtttgatctgtgcccttgctcagtgggttaacgatccggcattgctgtgagctgtggtgtaggttgcaga

SEQ ID NO: 88 - DNA, 8281 bp, Artificial
  ss573 sequence
ggcaaaacgaatgagaacaacatcaaagaatggcatcttgaaaacaagattgctgaagcattgatgttgctgatggaaaaccatcagctctgacattctcaggactggagccttgggggatttttgggagaggccatagatggcttgaagcaaacaacaaatgacagcctgggagggctaaagcatttatgattacttcatgtgctgaggaatggctgtcctagcatatcttgcttccaatctgtttgaagagaaataccgatgtatcccctgcatgtacaaggaagtagaaaatagtaaataaaaaccatgagtcggctcagagggttgctattgcgtctggaaggcggtagccccctgatccccactgtatttctgtgtctctttcttcttctttctgcggcaccattgactttgggacctgggttgacgagcaggcttcatcaagtggcgcccaaacagggacctgaagcggcttagagtctgcgagactattgaaaaggtgcgagcagatgcggggaattcctgctgaaaaggcgacggacggggaaagtacctggaggtgagtacacccccgtggattttttaatcagggtaacaatggggcaatctccttctaaacatgcagattatattattttactgaaaactttattacgtagctcgggtgtgaaagtgaaagatgaaaactttagagaattatttgatgcgattcctaaacattgctactggttggatcctgaaaaggagaccctgagcgtagagaaagggaaagaggtgatgccctgtttgtgccgtgcttatcattgtggagagtccattcctctgagtgtttggtccttatgtaacttaatacagactatggtagcccctttacaatctgaaaattctgattcttctgattctgagaaagaagattttcaagagcattcagcagtaaatgaggatcaagatgacagtattaaatctcatatttatgaaaatattgataaaggaagtaaagaaggtcaatttgctgaatactaaacataaaccttatggtactcacgccttccctgctccgccagcatcattttctcctgtttcacagccccctactccgtggccagagcctcgtaatttaaaaacagaaactccaccaattgatcctaatgtcccttgggaccatggaacatttttgacctctgttactatacctaacaagaatcctcatttgtctagctttcaaaaagctattttacaagcaagaagggaaggagaccttgatgcattggtgcttcctgtacaggcacagagaatacccccaatcctcaatttcctcagggtggcattcaatatgattatgagccattgtcttttaagactataaaagaaattaaacaagcctatgcgcaacatggatgtaattctccctataccgttgcacttctacaagcattggccccgtccgaacgtataatttcttatgattgggaaatgattgcctggacctgtttaactacttcagaatttttacagtttaagacttggtggcaagacgaagctacacaaatagttgggcgcaacgccacggccaatccacctgttaatatcattacggaacaattaatggggactggggaatatacaggaattcagaatcaattacaatttgatgataacataattgttcaggttcgttatgtgtgtcagtgggcttgggagaaggttagtccacctggacaaaccaccccttcagctgttaacattaggcaatcccatggggagccatatactgactttatagctagattaacagacaaacttcaaaaaactgtagccaatccagatctgagggagctattaatgaaaatgttggcttttgacaatgctatcttggaatgtcagaaggtattgcagccccttaaagcagaaggaaaacctttagaagaatatattaaagcttgtcatggagttcccgtcatggcgcagtggttaacgaatccgactaggaaccatgaggttgcgggttcggtccctgcccttgctcagtgggttaaggatctggcgttgccgtgagctgtggtgtaggttgcagacgcggctcggatcctgcgttgctgtggctctggcgtaggccagtggctacagctccgattcaacccatagcctgggaatctccatatgccgcgggagcagcccaagaaatagcaacaacaacaaaagaaagacaaaaaaagcttgtcatgatattggctcagaaccgtataaaatgcaattgcttgccaagctatagcaggaatacaaagtaaaaataattccaatactaaatgttttaattgcggaaagaagggacatttacaatttacaaattgtaaacaatctcctcgctctaataattataggccttctgtgaaaccggttataaatagtaataaggataattcttgatctcccggattatgtccctgttgttaaaaaggtaatcattgggctaatcaatgtcgttctaaatttcataaggatggttcccagcggttgggaaactggaagaggggtcctgctcaaggcccccaaaacaatatgagccaaaatcaaacttggaacgctgttccttttgtgtaccctcagagcagcccgaactccaatcaaacaccagccaatcccctcttctcacaatatcccacttattgcccacaacaacaggtggcatggccctagatatttctgttattgacaatatacttctaatgccttctatgggcatttataagatacccacaggaataaagggacctatatacccccgaggtagtgttggattactcctgggacaaagtagtttaactataagggagttgaggtactattgggaataatagatgaagatgatcacggtaaaattttattaatgataaaaatgaatataccttatcaaattaataaaggagatagtggaattcccattgtggcgcagtggttaacaaatctgactaggaaccatgaggttgcgggttcgatccctggccttgctcagtgggttaatgatccggcgttgctgtgagctgtggtgtaggttacagacacggctcggatcccaagttgctgtggctctggcgtaggctggtggctacggctccaattagacccctagcctgggaatctccatatgcagcgggagcagccctagaaaaggcaaaaagacaaaaaaaaagaaaattaaaattaaaaaaataataaaggagatcatattgctcaattattactcttaccttacattaagactcaacaatctcccattcaaagacaaggagttttggggagtacaggaaaacaagttttttggcaaactttcgtgtctgattaaagtccagtcctttctcttactataaatggatgaagatttgaaggcctaatagatactggtgctgatgtttcagttatatccactaaacattggccgtctaactggagtaccgagtcggtacccattatattaactggagtagggaccatgcaaaacatatgcaatgtcctacatatgcaatgtgtaggactggatggacagatagggaccttacagcctttgattgctgacatcccaataaatttgtggggaagagatttgctaatgcaatggggagcttatgtgactatcccaactctgtctcaacaagccaaaaatattatggccaacatgggttatgatcctttacaaaagagatcggttttttcataggggccattgttaagactacagcattgcagcttaaatggaaaactgatgagcctatttggaccaaacggtggcccctctctaaagttaaattgttagctcttcaggaattagtcaaagaacagcatgaacttggacatacagaagaaacaagtagcccttggaattctccggtttttgttattaaaaagaaaaatggtgttgtgggttcaatccctggctttgctcagtgggtaaagatccggcattgccatgagctgtggtgtaggttgcagacgtggtcattgctgtggtggaggctggtggctacagctctgattagacccctagcctgggaaccttcatatttcccaggaacggccctagaaaaggcaaaaagacaaaaaaaaagaaagaaagaaaaatggtaaatggcagatgttgacagacctcagaaaaataaatgctattatggaacctatgggtgcattacaacctggattgccatcacctgccacgattcctgaatcatggcctattattattatggatttaaaagattgtttctatactgttccattacatcctgatgatattacatgatttgcctttacaattccttctattaataataaagaacctgtcaagagatgtgtttggaaagttttgccccaaggaatgatgaatagtcctacattgtgtcaattttgttgcaaggcttttacacaatatttgaaaacaatttcctgaggcttatattgttcattatatggacgatattttattggtgcaccctgacaaagaaatattgcataaagtttttttgaggacagaagaggaattaatatcatatgggcttaagacagcaccacataaacttcaatgtgatgttccttatacttacttgggttatctaatggaaagagaaattataaaccacaaaaaattcagatacgaatagaacacttaaaaaccttaaatgattttcaaaaatcattaggagatattaattggttgcatccttcacttgatatacctaactatcaattgacgcatttatttcaactttgaatggggatcctgatttaaacagccctagagaattaactgaactagctaaggaacaactataacttgttaatgaggcctttcaaggaagacacattgtttgaattactccagaaaaaacagtttctttaataatattaccgatgaaaaattctactgccgtcttgtggtaagatagggtccattagaatgttaatatctaacccatacacctaagaaaaccataaccacttatcttatgcttgtttctcaaataatatctaaaggaagaactcgttgtaaacaaatttcaggatatgacccttcagaaattatagttcctttgaacagccaaatacaacaactttttgtagaaagtatggattggcaggagttcccgttgtggctcagtggttaatgaatccgactaggaaccatgaggttgccagttcagtccctggcctcgctcagtgggttaacgatccggcgttgccgtgagctgtggtgtaatttgcagacgcggctcggatcctgcgttgctgtggctctggcgtaggccggcagaaacagctccgattcgacccctagcctgggaacctccatatgccgctggagcggccctagaaaaggcaaaaagacaaaaaagaaaagaaaagaaagaaagtatggattggcagattgccttagctgagtatgttggtaaattacatccacattatcctaaaaatccaataatataattttttagtaaacatgaatggataatacctgttaatacaaagcaaagccctattgctaatgccccaatttactttactgatgccaataaagagttcaaagcaggatatacgggacctactacgaagatacaggtctcatcatatcagtcagtacagtaggctgagttggacgctattattaatgttctacaggatgtgaattcaccccttaatattatttctgattcattatatgctgtaagagtaacaaggaatattgagaccatgtcattacctgaaaacactcttaaacccatttttgttttgtttaacatattacaacaaattattcaacatagaaattttcccctttatatttcacatgtacagtcccattccctgttgccaggtcctactatgcaaggaaatgcacagattgataaattaattaggtgctcttctccatatgaatatcaccaactaactcatatcaatactaagggactgatgcaaaaatttgatatttctcgccagcaagctagagacgttgttgctgcctgtcctgaatggactctaacacaccctgttacccatgttgacactcttaatccatgaggaatccaatcaaatgatatttggcagatggatgttaatgcatgttcccccatttggtagaatgggatgtgtacatgtatcagtagatacttactcaaatgttagttttgcctcctcccatacaggagaagcagttaaagatgtcaaagcacatttattgcaggccttttccggtatgggtactccatcaactataaaaacagataatggtcctgcatatactagtttggctttaaataaattctttcaggactggaatattcagcatgtcactgcgataccttataatcctcagggtcaagccattatagaaagagctcataaaatgctaaaaaaatattatttttaaacaaaaaggggaatataggccttatgcccagggaaattctagcacaagcattattcaccttaaattttttggatataagaggatttaatgataaaccacctataatgcatcattttgagtcacaagacagtgggttagatataatccttctgctgatattgatgattacacccctgtattttagagaaatgaaaagggagaatggcttgagggatacagagtaaaaaagagatgaggttttgctcttatccttacagagaatggacaacttcactgggttaccagaagaaatatcgaagaatggaaagaaaagagattggatgagtctaggagttcccgtcgtggcgcagtcgttaacgaatccgactagaaaccatgaggttgcggtttcgatccctggccttgctcattgggttagggatctggagttgccgtgacctgtgatgtaggttgcagacgtggcttgatcccgtgttgctgtggctctggtatagaccggtggctagagctctgattagacccctagcctgggaactccatatgctgcaggagcggccccagaaaaggtaaaaagacaaaaaaaagaaaagaaaaaagaaagaaattggatgagtctagatccagtcagggagcctccagtacatgccttgaaataaatgtcagtttattcgtcacaagagaaaaagtcaataccattgcctcaaacgagtaatagtaaaacaccaacatgggggcaaataaaaaagctcactatagaaggggaaaaactggtgagagatcatcattaccctttaaatgcagctacgttatttgtggctataatggcagatttacagcaggtggtaattttgttgggagataagtgaatagtttacaaaaacaaataagacttaaatgtgaatggaatattacttcattttgtgtgactcctcaccagtataacaaatcatcctttaattgggataaagtaaaacaacatttattaaatcaagggaacttgtcaattgatattaataatatacgaaatgagattatggaaactttctttcagaagttacatttacttcaaggatctaacgttctggaggctgtggctgatggtttatcacaactaaatcccattcctcacttaaagaccactggcggtactatggggctttatgttcatattcatatgtctgttttttttgtttctatacagtctggagacgaattacaacagaaatcaatggacgacaacagcaattagccactatagcacttgccaatatgattaataaataagaatcataaaaattttaaaaagggggagacgttggaggtatgaatatgcaacatgacaaagaatggaaagaaaagactggcgccatagagtggctgtagaaggtcagtctatacagagtcttgtgactctcatgacccttgaggtaacatcaaagaatggcattttgaaaacaagattgctgaagcattgatgttgctgatggaaaaccatcagctctgacattctcaggactggagccttgggggatttttgggagaggccatagatggcttgaagcaaacaacaaatgacggcctgggagggctaaagcatttatgattacttcatgtgctgaggaatggctgtcctagcatatcttgcttccaatctgtttgaagagaaataccgatgtatcccctgcatgtacaaggaagtagaaaatagtaaataaaaaccatgagtcggctcagagggttgctattgcgtctggaaggcggtagccccctgatccccactgtatttctgtgtctctttcttcttctttctgcggcaccattgactttgggacctgggttgacaagcaggctgcgtca

SEQ ID NO: 89 - DNA, 7473 bp, Artificial
  ss581 sequence
  misc_feature (1448)..(1547): n is a, c, g, or t
tggtgctgagacctgggagggattggcaaggggacaggaagccggtcagtggtgccccaaacccctggatttgcaacccagagagcagcaggcagtggcagcttgtcctgggctaacctccagatcctacccaggtttgggcccctgatctaggcacctccccaacaatcctcttgagcaagtgagggggaaattaggagggagcactgaaccgggaactctgcctttccgactctgtatccaacatcaatctcttaattctcggttgagtaattgccacctttccgggtcttctgtcgacacagccactggccccagttcctctgacacaccagaatgcaaccctcagacgaaccctagctctaggtcagaagactacacagccactcagccctggttcctctgatctggggacgcccacaacagagtgtgacctctctctgtctcttctcaggtccactactcaggccttggggacacccagcctgagtagtgcactcccaaaggtggtcctttactttaccctccatcccctcttagtcctcttgttccttctcatcatgaggaacacttcctccactcttccaggaacacacctcttggctgcttcttgcgaaattcagatagtctcagactaagatgagacattaggtccaagcgtcttaaatttataacacctctttgatacaatacagattggataacaagtctcaagacccaaaaatggcactttcaattttaatcttgtatgacctcaataacttttgtcgccataatggccagtggtccgaagttccctattcaggccttctttatcccctgctcccaaccctccttctgttcatcttgctccacctttcaaattctttattcaaaagattcacaaccacctccctctgattctgatatctcctcctttgatcctgcatatcatcctcctcccccatatgaccctctccatgccaccagctctcccaccaacttgcaatcatcctctcctccaccctcagcttcctcacttcatcccaatcctaatccagatccccactcctttttctcccttcctcatacatggtcccagacccaacctcctgtctccaaagacatcccccaactggctcctttactccctttacaggaagttgcaggaactgaggggactgtctgggtccatgtgcctttttctatgtccaacctctctcaaattgaaagattaggctcctcttctcacccctccacctacattaaggaatttgaatatctcactcagtcctatgaccttacctggcacagcatctatatcatcttatcctctaatcctccaccctctcccccaaagcaaaggaaagggtctggttagccattcaggcccatgctgatgatttccaccatcaaaataaccaccagccggctggggcagtggcagttcccagacaaaagccactggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatttagacccttcctcagtagaaggaagtcttttcttaaacactcacttcgtctcttaatctgcacctgacataaggtgcaaactacaaaaattagaggatggccctcaaaccccacaaagggatctcttgagccttgccttcaaggtctttaataatcaggatcaagagcctgaaagccaaaaattaaaaagagatcaggctaaataccaaatggcaactgccatttggggctcccaaagattcaggttccctcacaaagacaatggctctaaggcccctccaggcccatgttacaggtgaggcaagaaaggccattgggcagaggaccgccctaacccttgatctcccccagacctttgtccacagcgtggcaagagaggcccctggaaggtcgactgtgaccacattccttcctatggagagaccggaatcatcagacctcaacctgccaagccaccttggcctggccacagaagactgagggggcctgggctcctggcttccaagcctatcactccatcagagccccgggtaactttgctggtggcaggtaagctgattacttatcgacacaagggccacatactcagcattacctaaatttacaggttccacgcaccactctcaaggctccattgtgggggctgatggcctaatctccaaaccctaaattgctcttcatcagaaacacccttcagccattctttcctgatattacccaggtgcccaacccgattctcagcagagatattctatctaaattcagagccttagcttctcactcctatctatgtggccgacccttccctcttcctccttactcatccaaaacctgataaactacctctcccagtcaccatcgtttgcccaaggtatgttaaacctccaccccttccatagctcatcatgctcccacttaaattaagttaaaagacctgtccaaattcccctatcaaacccaatatcctttgtcccttaagagcagaaggggcctccaacttattattaactgccttctttctcgtaacttactccaaccaactcattccccattcaacactccaatcctactggtaaaaaagtcagatggctcttaccacctcatccaggatctcttataaaccaggcagtcttccaactcacttgggggttcctaacccatataatatcctacctcttattcccccagatacctcccatgtcatggtactcaatcttaaggatgccttctttcccatccctttatacccagactctcaggaccttttcaccttcacctggacagatcccgacatccaccaatcacgtcagcttacctggaaggtccttccccaggctttttgggatagcccccattctttctggacaggttctagcttcagatctcaccactcttgatctcacctttagcaccctcctccgatatgtggatgatctcttactctgtagcccatcttatgacacttctcttaaacatatggcaacattttaaaaccacctggtcaatagaggatattgggtctctcccaccaaagctcaactttcctcccctcgggtcaaatgccttggattctctattacccccattgggttatcactgtagacagaaaatgggtctctctcctcccacttccaaacaggagctcctatctttccctggccttgtgggattcctctgtatctggaaccccaacttcgggcttttgccccatctccataccaagccaccatagggcctctaaaggagcctctggaccatattatcaagaacaaagtcccgtccataaattacaacaggcccgttatttctgcccctgctctctcccttcctgacctaacaacccttcaaattctacaacagaaagagaaggaatagtacctggtctattgggcttatttgggcatttgctcttctctttctcactcttccctgtgacatgattccctggtgctcctcagactgcctccaccaagcatttattggggaaacagctccctttctctagattaatagtcctctatgaacagaccacattgtccttgtgcattctgctttcccctaatcttaacaccccatattccctccctccacaaatactgtccatactagccactgtccctctcaatcttcattttcataccctcaccttactgtgggaatcactcctacagggagactgtgattacccatggagttggatcacacaccctctggatcatttgtgagagataatccaatgcataagacccccacaccttcctcttccaccttactaaccctaatacttctctttcaacacctgccctcttctggagggtctcatcaccccctcacccctactgtccagtctatagcacaggtacaaacctaaccaagtgttggatttgtccaaaaacttttcacaagtcctcaacagttttatagaccttttctctaagtccagagatccttcttagcataactttaaattaccataaggcctccattttctaaaagagcaactgcttaggactgatttaagtaaatttccaagagcctatcaaccaatagggaaagttactcatttggccaataaggtctatctctgtttccaacatatatccaactacaactaatctttatccttaggaaacctgaatcttttttactgcaaccacacactcgcactcaatgtcaccataggtacatggatgtctctgggtccccatatgcctggcgggcgaacacaacataatacttcactggggaaagtttccaaaataccacacaaaaacttatgaacataatctctttatctttaataactctcacattatactttttgggccaactgatcaaagagaacagactctcactaaacccatggttaatggaacttttacctcaactggcccaaaaaatgacctctttcatcttttattccaaaacctgctctgtcagccctcccctcaattttgttataaatttgaaactgctctaaaaaagtctttttttaaaaaaaaggtgtatgcactgaacaatgaatagaagttaattggttacaatgaaaaataagggtaaatttcagggacagatggtgaaaaatatgtattgcatgaattcaagctaaatatatgtattataagcagcagtaaataagttccttttattttacaaagttttaggactttagagctcccaacacctatttacatgcatttcacgtgatattcacaatatccatgtacaaaaggcaaggttaatgttatccaccttttacagatgaaaaaactaatgctcaaaatctaatccttctgactcctaatccagtactccttcaagggccaaaataatttaacaatttggcaattaactctctagtctttattgaaaacttcaatattaagatcaaaaagactcacaaatggtagttcaggagatgcagggacaaggtatgaagcacaagtgcttctgaaattataaaattttacaaaatgttagtagtggtggtgattctcttttaagcaccatttctaagctttctgaacccagagatggaaatgccatttcagtcccaactacagtatagccaatgaaacactccaggcccgccgaatacagagtcaagacctgctagaatgtccctttcctccatcaattccttatgcacacagaacagagccagtgtggaagggaggaaattgcagccctcccattttatgaccttcatgcggtggctgaaggatttaaaacagccagccagatcactcagggaggcccgacacttcgggaagccttctcttcatgttttatttgcttctgtcacagtttctgtggaagtgatgaagacaagtccttcctggcagctgaccctgccaggccttcccacactccccagacctgaggccaaggagtaggggtgggagtggggcagggtggcccctatctagggtggcaagctcatagcagactttcctcagagccctatatactacgtgtgctgtacaaaccactgtgactgagaggcactctctctaggctcagccaaatttaaattcaaatcgaagttctacctctcaatagctgagtaattgtgagcaaattacttaatttgtctgagcctgtttcatcttctgtaagacaaggatagtaataatccctacctctcaccaccatagagcttttcataaaacactaattgctaactattgctattattgtttaacaatcactaccaattattattagggaattaatatacctataaactggtcagagattaatgaagtaaaagatctaagagagtttgagtccaggatctttgggtcaacggatcagagcattgattgtccattcttcttcggagtggttgggagagatttttcctggggaatgggtaaagtgcattcattttctgatatagacatagatatagacagagatatagatataatatatatgtataatgttaataaatatgtatttttttaaggaaaaggagaaaaagcctcctcccttccagtgcccagtgtccactggcttggcaggggtggagccagggcaaggcccgcaagagaatgtccaggaacaaaaggcaatagaattaacattgtggtccatggggaggaggtagcagtgtgcctggcccctagactggctccacccatggtggaggaatgcagcctcattagggtgaagctagaggagttctgagcctggatctctctgccctgagctagcaccaaaaggaaaccttccttcagcagctcccagctcttcccccatagaacccacacagaatggggaggccagtctgtgtggggagaaagaaggctcataaagcaagtaggaaatttatgtccaatactcatgcaatccttaccaccactccagtactactgtcttcattttatagctaataaaagtaaggggcaaagagcaaggttacagtgtgggtaagtgactgatccaccacagatgtatgtgactctaaaacccagttctgtctaaagttccatagggtatcacccaggtccaagaaagagctcatgaatctggaagtcttggaaagcaggatttagctgccattttacctctagctaactagtgaccttgggataaaatgagacagtggccttgacagtagtttaggacctagcacagctgcctgcattccgggagtgtgatccagtgtgtgcccaggacctagtgcactgagagagaaccatcctcatctgtggcgtgcccacccatctcaagagcaaatccctagctctgtctgcccaccttgtttcccaggagcttctcttcatctgccccttcctcctccaccctacacatatggtcccccctgctgggacggatgcccactcctgctctaagccacacattcagcaacaatcaagtgggcaaagctgaatttaataatgtctccagggtaacattaaatcacattaattgctatttatttcctctgagatttagttattaacaattcatatcctgaaagcatgaagaatccccaaatccttaaaagttctgaagaaaggcataagctgaagtttggccaagagctgcctggggccctttccctcgcctcctcccaatcctaccccgcctgctcagccacaggaggagccaagggcttcctggagagcagttcctgcagaacctcccacctctgaggacctcacagagggcaacagcagcctctagttttccctgtgatgttccaaactaattcaaaacctggggtcccagcttcactggaaggagcaaagggttaggactctggagagagtgacacgcagctaactgttagcagttaatcacctaagaatgttccaccagcgattcagacctgggtgtgggaaatggagttaggaggtattcactgctccaacaccgcaagtaaccttaggggaaaggtgagagaaaggagc

SEQ ID NO: 90 - DNA, 8160 bp, Artificial
  ss588 sequence
tgcttgattatccacccatagcccctcctcatgtgatctcatcaaaagagtaaaataaaagcggtgtggtttcttgaggcggggctcttggtcctagagaccttgagtcccccaggttcccacctttactgtctctgtctctgtgttttgctttgtgttggcattttgtttggggttggtttttttccttaagttccacagcacccgttcttcagccccatcctgttgacctggtctctcggcaagtggctcccaaagtggggcgggcaaacaagcagctatgaagaatgaaggaccatgactacagtgggaaattttattcattgtaagtgctgtggagtcctgagaagaagggaggaattttgtgtggccacactgaagaaatcctgcagatacgttcactctctcaggtatttacggggtaacatgggaaataagataattgcaggaaactataatccttacatctatttgttaggacaactccttaaaaaagggggtgcaaaaataagtgaaagtaagctttgggaactttttcagactattgagaaacattgtgattgacttcttacattagaaacattagatttaaagatatgggaaatggtaggtatggaacttaggatattgcatgatgaaggtgtttcaattcctgtgtctatttggagtacttggagcttaattaaatcagttttagaacctctacagaccacagaggacttagaggaggaagaagaatgggagtttacacctttgttggaagaacctaaatatgcagtccctgaacaaaattatcagagaatatttggctcctgagcctttggctccaattgttgattctgatattcctcaattgcctcctattaggagtaaggtgatgaggactcatcaagtctctacttctagggttgcaaagaaaatgagcgttattcctgaacaccatctatcatccattcaacaggggatattacaggcttgaagggaaggtgatttggatgccatacatttagcctttccagtaactgtcagggagacagtggctccagacattgatctcaccaacaataatggagtttatgagttcattcatgagcactttcctttcaaaattcttaaagaattaaaacaggctgttcgaaactatggtgttacttctccctttacaaaaggaatcatgcagggagtagctgaaggaaatcatatgattcctgctgattggcataacttaacccgtgctgtgctatcacctggcgaatatttacaattcttggtggcaagatcatgcccaaattactgctaatcataatcaggctcaaaatcttctgattaacaatggaacaattgttagggattggtccttggaataatcctcaagatcaaatgagaatgaatgatttggctattgaacagattagacagtgttacttaatggcatgggataaaattgaatctaagggtcaaataagtacttctattcaaaagatcctacaaggccctaaggaaccatatactgaatttctagctcatttacaagaggcattaaaatgacaaattactaactctaaggtgtttgatactatttttcaattgttagcatatgagaatgcaaatactgattgcaaaaaggccataggatttttttttttgtctttttgtcatttcttgggccactcctgtggcatatgggggttcccaggctaggggcctaatcagagctgtagctgccagcctacaccagagccacagcaacgcaggatctgagccaggtctgcggcctataccacagctcacggcaacgctgaatcattaacccgctgagcaagggcagggattgaacccccaacctcatggttcctagtcagattcgttaaccactgcgccacgatgggaactccaaggacataggatttttaaaaggaaaagctaaaattgctgaatatattaaagcctgtcagggagtggggacagagtcctttaaggcctcaatgctagcccaagcaatggccaatttaaaggttaaagacaaattttcagaaaagtgttttaattgtggcaagacaggacatactaaaaaacaatgtcgtgctcttctacaagcccgaactttctttcacagagctttggcaccttctagtaacaatataaacagcccaaactatgtccaagatatactaaaggaaatcactgggctaacaagtgccagtccatctttcataaagatggaacccccttgtcggaagccacccttggggcaagcttccagccctgtcaaccaaggaagttttccccattcagaataggagccaaactctcaactgatgcaagagtccctgggactatgctctgcacgagcattcaccatcccagtagatctccctagtttacaggatttaattctctttcctagtgaaactcctacttctattacaactaaattggaaaatctattaccaacagatatggtaggattgataataggaagggcagggctaacagaacaaggagtttgagttcataccgggatactggataataatagggcatgataaagtacaagtgatggtttccactgtgattccttggaaaattaaaaaaggggattggattgctcaaatcttaattttacctagagtacagaagaataaagagaggaataattttagacagaagggattcaataccacaggaggagcggaagtgtttttatcagaaagggtcctagaggaatgacccacttgtcaagttatcataaatgggaagtcttttagaggaatgattgatactggggatgatgtttcaatcattagccatttacattggccagacacctggcctcttcacccagccaaattgaagtcactgggttaggaaaagcagagagcctcaaaaagagtgcccaatggcttaattgtgatggaccaggtgggcagccagctagattgaaaccttacattgctcaacttcctatcaatctatggggaagagatttattacaacagtggcatgcagaaatatacttactaccaggggatcaatatagtcgtcaaagccaaaaaatgttacagaaacagggttacattcctggactggggttagggcgatatcatcaggggagagtggacctgttgaatctgagattaaaatggacaaatctggtttgggatatcggccttttcattagtggccactgcttataaaaataattatgcttctcctgaacctattcaattaaattgaactacagaaaagccggtttgggttgatcagtggcctctttcttcagaaaaattaaaggttttaaataatcttgtccaagaacaattagagaagggccatatagaagaatcctttattccttggaattttctgctatacagaaaaaaatcaggaaaatggagattgttaacatatttaagaggagtaaatgctgtaattcagcctatgggtgcccttcaaccaggcctcccatctcctagtatgataccagctgactggttgttaattatcctggacttaaaagactgctttttcacaattcctttacacccagaagataaggaaaaatttgcttttcagtgccagtggtaaataatatagcccctagaaagcgttatcaatggaaggtcctgcctcaaggtatgttaaacagccctaccttgtgtcagtattatgtggcttcagttgttgacccagtccaaagacaatttcctatatgctatattgttcattatatggatgatatactttgtgctgcaccctctcaggagcagctcactgaagtttttcaatgcttgcaattctgtctaaaaggaggaggattgattattgctcctgaaaagattcaaatgaaaagtccatatcaatatctgggaactgtggttgaatgtaccactgttcaccctcaaaaggtagaattgagaagagatcaaatttctacattaaatgatttacaaaaactgttaggagatattaattggctctgactttaattggctctgaccttatttggggattcctacatatgaattgtcaaatcttttctccttacttaggggagattctaaattaaacagcccccgctctctaactgcagaagtggaagaggaactagaaaagattgaaagtaaaatacaaaattcccaactaagtcaggtcaatctaaaacagcccattcagttagtaattataccctctcctcattctcccacaggaatattgatacaattagaaaatagtctcgagtggctttttcttcccaataatgtcacaaaatctttgtctccgtacctggacctgatggcacaatttattctaaaaggtcgtactcgttgtgtaaaaatgtccagaaaagatttgaatcatgcaattgttagtttaactgttaaggaaatccaacattgttttcaaaacctatatatacaggttggcaaattgcctttgcatattatgtaggatcaatagataatcattatccaaaaaatcctattttacaatttataaagcgaactcaatggtttctgccaaaaaaggtgaaggattcacccatcattgaagcccctgtgatctttactgatgggactagtaaagggaaggctggatatgtggctaatcaatctaaaattatagaaacacctggcctttctgcccaacaggctgaactaactgctgtaatccatgtcttaagggactatcctgagcctatcaatattctttctgattcggcatatgtagttcatgctgccaaaatgattgaaactgctaccattaaacaaaatttacctatcttgctatttgactgtttacagaattacaaactgttgtaagggaaagaagatatccattttatattactcatatcagaacacatactaacttacctgggcctctagttgcaggaaataaagaaattgattgcttggtaacacctgtgttacaagaagctcaacattttcatgatttaacacatgtaaatatttgaggccttaaaaagagatttggaataacatgggctaaagctaaaacaattgtccatcaatgtcctgcatgtcaaattattaacaatccttcccaatctgagcctggagttaaccctaggggacttgtcccaaatgctctctggcaaatggatgttactcattactcatcttttggaaaattgtcatttattcatgtattgacacttattctaaatttatttgggctactgctcaatctggtgaatctgctaaacatgtatttgtgatttatatgcttgttttgcagttatgggcctgcccacaagcaattaaaactgataatggtccagcttatatcagttctcaacttaaaatattcctagatacatggcatattgctcactctactggtctcccttacaacccccaaggacaggctattgtggaatgagccaatttatatgtaaaacaggctcttcaaaaacaaaaagggagagacacagaaatagttaagtcataacaaacacttttaaacaaaaccttattcactttaaattttttaaatttggcctctgaccaaaaaaaacggctgcagagagacattttgatacagatcaaaataagattaattttcctcaggttgaacagcccttgatttggtggcaggatccattaacaaacttctggtctctgggaaaacttattacatggggtaggggatatgcttgtatttcaccaggtcatggattacaacctgttaggatctaacccgagaagctgaaaatctactaagaggagaaggaaagcctctcactccaaataatttggtcctagctatctttactttggtttctatcgcagtgagtattctcacaattggcatagaaatcattttattacttgtatagtagagggattaaaagcctcatgagtaaagcccattaaaaactatcagaggtttactagaagaacaagagagcccatcaactttcttagaaagactcagaaaggcattgagaaaacatataccaaggaacccagaaacaatggagggccaaataattcttaaggataaattcatagctcaattggtgccagatatatggagaaagctcccaaaattggcttttggccctgatcaggacctggagcacctcttcagagtagcaactcaaatatgttataatcagggccaggaagaatgaaaggagagcaagaagagagacagagaaaaggctgaggctctagttatggtgcaacagggagtcaacctgggagtttccaagatgagaggaccaggtcagagacctatgcctggagcctgtttcctctgtggaaaagagggatcctttaaatgggaatgccctttgactcagctgtgccccatatggtggagagatcactggaggagggactgctcctgaagatgaaggtctctggggttgacccctcaggcccagaatcaggactgacggaacatttccataatggctcctgtccttatcaccactcaggagccctcggtgactctaaatataggaagacagcctattgacttcctcctgaatacggagccacttttcagtcctcttctccaatcctgggcccctccctcattaatccgccacatttatatttctagaaagccggttacaaaatttcttacacaacctttgagttgtgactgggaatccattttcttttctcaatgcctttccgattgttccagactccaactcttttagaaagagatattttgtaagaagttaaagcctcaattcacatggcaatggaggacttcccatgtggctcacaacataactactcagcaatccctcacattttagcaaaatgatagtgtatgtcagtcaaatgtaaagcttttattagtattaaaacctggtgattaatgaagctcatggaaaataggttaatctgaacaatatattatttcctttcagttcacaatcttgttatttcacagaccatggttaatagaacgccccaaaaaataaaattaaaaaaaaaaaaaaggccaatggagcctaatgaaggtttctgcatttccttaactaaggccttgttattataaaatctaaatgttgtattgccataattgttcatagaacgtgtctcattccctgttagatcttcaacagtagattcatgagctgtcctgtccagctccagcttttggagctgctttgtggaactagctgacctcctcttcctggtgaaaatgtttcttttgccgtgttcattgtgatctttatccttttattcagaccttctataattaattgtatttcttgcttcattacatcttgattaagagctattaatgttcaaatgttgatagaaggggtatccaaagcaatgtatcaaggcccacttgactgttccatgagtggagacctgttttccctaacgacatcccttttcagcaggaagaagttagagtggtcatcgccccttttcccacagttagagtctccaactcgggggtggggattgagaatgtgggctttgatacattctttgatgtggctattgattaacatttgtaaattaagggtcgcatagaaccccaactgatataaagtttacagttattaccctctggaaccatcctctgctaccacattatactcaagaggtctgcatccgtggctgacatggacacctgggaggctgtgcagcaccttgagaatccccttatggtcaagttccagagactcccttccatggtcagagaatgctaagccctgctctggccacccctggaagctggtcagtctacacatggcagaagcccaaggagttctatgtgagacttaacttggactctgagacttaacttggactcacattctgtctatagatgtgggaagcaagcgatttgggaagtagtgaagaaaggaagttagcgggatctgtttttgtcctcctgtaaaaacaaaaagggggagatgtcacaaaacatgtttttccaatcttcttgcttgattatccacccatagcccctcctcatgtgatctcatcaaaagagtaaaataaaagcggtgtggtttcttgaggcggggctcttggtcctagagaccttgagtcccccaggttcccaactttactgtctctgtctctgtattttgctttgtgttggtgttttatttggggttggttttttccttaagttccacagcaccca

SEQ ID NO: 91 - DNA, 10172 bp, Artificial
  ss710 sequence
  misc_feature (8663)..(8762): n is a, c, g, or t
atgggacagacggtgacgacccctcttagtttgactctcgaccattggactgaagttaaatccagggctcataatttgtcagttcaggttaagaagggaccttggcagactttctgtgtctctgaatggccgacattcgatgttggatggccatcagaggggacctttaattctgagattatcctggctgttaaagcaattatttttcagactggacccggctctcatcccaatcaggagccctatatccttacgtggcaagatttggcagaggatcctccgccatgggttaaaccatggctgaataagccaagaaagccaggtccccgaattctggctcttggagagaaaaacaaacactcggctgaaaaagtcaagccctctcctctatctaccccgagattaaagagccgccggcttggccagaaccccaatctgttcccccaaccccttatccggcacggggtgctgcgaggggaccctctgcccctcctggagctccggcgatggagggacctgctgcagggactcggagccggaggggcgccaccccggagcggacagacgagatcgcgacattaccgctgcgcacgaccctcccataccggggggccaattgcagcccctccagtattggcccttttcttctgcagatctctataattggaaaaactaaccatccccctttctcggaggatccccaacgcctcacggcgttagtggagtcccttatgttctctcaccagcctacttggaatgattgtcagcagctgctgcagacactcttcacaactgagaaacgagagagaattctgttagaggctagaaaaaatgttcctggggccgacgggcgacccacacagttgcaaaacgaaattgacatgggatttcccttgactcgccccggttaggactacaacacggcagaaggtagggagagcttgaaaatctatcgccaggctctggtggcgggtctccgaggcgcctcaagacggcccactaatttggctaaggtaaaaaaagtgatgcagggaccaaatgaacccccctctgtttttcttgagaggctcttggaagccttcaggcggtacaccccttttgatcccacctcagaggcccaaaaagcctcaatggctttggcctttataggacagtcagccttggatattagaaagaagcttcagagactggaagggttacaggaggctaagttacgtgatctagtgaaggaggcagagaaagtgtattacaaaagggagacagacgaagaaagggaacaaagaaaagagagagaaagagaggaaagggaggaaagacgtaataaacggcaagagaagaatttgactaagatcttggctgcagtggttgaaggaaaaagcaatagggaaagagagagagattttaggaaaattaggtcaggccttagacagtcagggaacctggactataggaccccactcgacaaggaccaatgtgcatattgtaaagaaaaaggacactgggcaagggactgccccaagaaggaaaacaaaggactgaaggtcttagctctgaaagaagataaagactagagaagacggggttcggaccccctccccgagcccagggtaactttaaaggtggaggggcaaccagttgagtttctggttgataccggaacaaaacattcagtgctactacagccattaggaaaactaaaagataaaaaatcctgggtgatgggtgccacaggacaacaacagtatccatggactacccgaagaacagttgacttgggagtgggacgggtaacccactcgtttctggtcatacctgagtgcccagcacccctcttaggtagagacttattgaccaagatgggagcacaaatttcttttgaacaagggaaaccagaagtgtctgcaaataacaaacctatcactgtgttgaccctccaattagatgacgaatatcgactatactctcccctagtaaagcctgatcaaaatatacaattctggttggaacagtttccccaagcctgggcggaaaccgcagggatgggtttggcaaagcaagttcccccacaagttattcagctgaaggccagtgctacaccagtgtcagtcagacagtaccccttgagtaaagaagctcgagaaggaattcggccacatgttcaaagattaattcaacagggcatcctagttccagtccaatctccctggaatactcccctgctaccggttagaaagcctgggactaatgactatcgaccagtacaggacttgagagaggtcaataaacgggtgcaggatatacacccaacagtcccaaacccttataacctcttgtgtgctctcccaccccaacggagctggtatacagtattggacttaaaggatgccttcttctgcctgagactacatcccactagccaaccactttttgccttcgaatggagagacccaggtgcgggaaggaccgggcagctcacttggacccgactgccccaagagttcaaaaactccccgaccatctttgacgaagccctacacagagacctggccaacttcaggatccaacacccccaggtgaccctcctccagtacgtggatgacctgcttctggcgggagccaccaaacaggactgcttggaaggtacgaaggcactactgctggaattgtctgacctaggctacagagcctccgctaagaaggcccagatttgcaggagagaggtaacatacttggggtacagtttgcggggggggcagcgatggctgacggaggcacggaagagaactgtagtccagataccggccccaaccacagccaaacaagtgagagagtttttggggacagctggattttgcagactgtggatcccggggtttgcgaccttagcagccccactctacccactaaccaaagaaaaaggggaattctcctgggctcctgaacaccagaaggcatttgatgctatcaaaaaggccctgctgagcacacctgctctggccctccctgacgtaactaaaccctttaccctttatgtggacgagcgtaagggagtggcccggggagttttaacccaaaccctaggaccatggagaagacctgttgcctacttgtcaaaaaagctcgatcctgtagccagtggatggcccatatgcctgaaggctatcgcagctgtggccatgctggtcaaggacgctgacaaattgactttgggacagaatataacggtaatagccccccatgcattggagaacatcgttcggcaacccccagaccgatggatgaccaacgcccgcatgacccactatcaaagcctgcttctcacagagagggtcacgttcgctccaccagccgctctcaaccctgccactcttctgcctgaagagactgatgaaccagtgactcatgattgccatcaattattgattgaggagactggggtccgcaaggaccttacagacataccgctgactggagaagtgctaacctggttcactgacggaagcagctatgtggtgaaaggtaaaaagatggctgggacggcggtggtggacgggacccgcacaatctgggccagcagcctgccggaagggacttcagcgcaaaaggctgagctcatggccctcacacaagctttgcggctggccaaaaggaaatcctgccccacaaaaaagggttaaaatatgtccaacagatacatcgtctaacccacctagaaactaaacacctacaacagttggtcagaacatccccttatcatgttctgaggctaccaggagtggctgacttggtggtcaaacattgtgtgccctgccagctggttaatgctaatccttccagaatacctccagggaagagactaaagggaagccacccaggcgctcactgggaagtggacttcactgaggtaaagctggctaaatacggaaacaaatacctattggtttttgtagacaccttttcaggataggtagaggcttatcctactaaaaaagagacttcaaccgtggtggctaagaaaatactggaaaaaatttttccaagatttggaatacctaaggtaatagggtcagacaatggtccagcttttgttgcccaggtaagtcagggactggccaagatattggggattgattaaaaactgcattgtgcatacagaccccgaagctcaggacaggtagagaggataaatagaaccattaaagagacccttactaaattgaccgcggagactggcattaatgattggatagctctcctgccctttgtgctgtttagggttaggaacacccctggacaatatgggttgaccccctataaattgctctacgggggaccccccccccattgataaaagttacttctgtacatagtgctgatacactgctttcccagcctttgttctccaggctcaaggcacttgagtgggtaagacaacgagcgtggaggcaactccgggaggcctactcaggagaaggagacttgcagatcccacatcgtttccaagtgggagattcagtctacgttagactaagtgcagtccagatcatggtacttagacaacagtaccaaagcccgtctagcaggaaagctggccactagctctaccagttctaagattagaactattaacaagagaagaagtggggaatgaaaggatgaaaatacaacctaagctaatgagaagcttaaaattgttctgaattccagagtttgttccttataggtaaaaggttaggttttttgctgttttaaaatatgtggaagtaaaataggccctgagtacgtgtctctaggcatgaaacttcttgaaactatttgagataacaagaaaagggagtttctaactgcttgttcagcttctgtaaaactgcttgcaaaagataaaaggagaggaggttaatctctaaagcaacctcaaattggttgcgccataaagatgttgaaacgttgatacacatatcttggtgacaacatgtctccccgaaacatgcacaaatgtgtaactccaaaacaatttaaattaattggtccacgaagcgcgggctttgttgtgaaccccataaaagctgtcccgactccacactcgccgccgcagtcctctacccctgcgtggtgtatgactgtgggccccagtgcgcttggaataaaaatcctcttgctgtttgcatcaagaccgcttctcgtgagtgattaaggggagtcgcctcttccgagcctggaggttctttttgctggtcttacactacaatgctattttgctatgaccgtttttcttcaagcaattcttttttgtccaggtcacatcagctaccatcatacagaaaactcaactcccaccgattttttttttgggggggggcatgctcgtggcatatggaagttcccaggctaggggtcaaatcggagctacagcggctggcccacaccacagctcatgggagtgcaggagccttaacctactaagtgaggccagagatcgaacccgcttcctcctggatactctgagccacgatgggaactcccctactggtttttatgatgtgactgagcgtgggaatcccatctacctcaccagctcagtctcccccgccttattgcttcctgcaacctaccagtgtgtgtggccaggaaaagctaggcaccttccatctggtttccttctttctcatagttgccacatggctaaactgctgctgcttttacctaactctgtcttggttctaaccaccttccttatggctggggcggctgcttccgcaaggttcccaccacactggatgtgtccagaaagcaccctgccccttccaccaagctgggccaaaagttactgtccttccaaatcaaggtcgaaggacatttttgtgtcctaaagtgacaggtctttcaaccaaccttagagccaaaatagagccaaaatattaccttgataatgcagttttataactaacttgctaagacctgacacagaaaaagtccatcccaaacacagactaagttcaggttcaggacatgaggcaagattgttcaagtatctggagtctggggttctcatggtcagccccccagtttccttttcctttttctcagggagccagagcccttgcatggttcaaacttttctgggtggtcttccttggcaccccgagtacctgcatgtatacagaactcttgtcagcagcattttcattcatatgaagacctgttgaggcccatactgatatttttctaggccaggctcagaaatattacatttttggaaacataaagatatttgctgtagttatgttttggaggcaagaatggtttattttttaaatggttttatgtgttttctacactttaagaaaagggcagagtcagagtcaaagaacagcagatgtttactgttaaacctgaaaacatttctcaatcctgtttactgtcactcctctcacttaagaatctgtacagtgagagtcacgttttccaagccctaacgtgtcttaattttttcctcttagtcattgcttaaattaacatccggaggtgctcttttagaaagcctgggatatataaagtgtgtccctttcattctctgtattctatgtcttcttggaccctggctctcagagctgagctcaagttcttggtcaagctgaactatgcagacagagctcttggttcctcagctctaaggagtaaatgccagcttgactctccagcacctactaggggctgggacgggagtgggtagtggctgcagccactgcagttgggaagacggtaggttctgctgaccctcacttgactgagtcaatagaacaaacattgacaatcaaagggatactcttgattgatgtatactgatgagagtcatggtggaggctgcaggacgtagggggcaggggtgaagatccgagtagaaagagcttgaaaacagaatcaaatttattagagttgctggtggagacggttcataattcaaagtgtttctttggatcagagagtcacgggtctcttttaaattgagcatttaaaattttatttttttatttttttttagttttaaaaaaaagaaactagcggagtcccccaaaataaaaattgggctttggcagaaaactgcttcttcttgccatcagagagtcatgcgagtctcaggaatggcaaacatctgtttgatgggcatcccgactttggcttggcagagatcttagcagaaagagcatcatgatttgatgtgtagttttcacttgtgataggaagcgtggtgggttgtagtgcagccaagcattaagaacggaacagctattcaataaatatttactgagtatcactaaatgactacgtgccagttattatgctatgtgctggggctacgacagttactaggacacacctaggacccaaataggtgtcacatagacactgggataaaaggtcacagtgttttgtcctgaatattctgagctgtacttgtgcagcttagaatttggtaggtaatttcaatgcatgtaatacacaccactgggagaggctaaggctagttcaagatcaggcatgtgatctgcagagccagttatatttttttctcttgaccatttactcactggcgtattagcagaccttccctgagtggttgtattaagattaaaattataaaaagagtctgagactctgtttgcttctgtaaactttttattagatactttttggaattcagaattccacctgagccatactcgagcttctgagttggagccagaaagtcatttatctgatgccctggacaacatgactctatctagataaaataatggttggatacataatatattatgtaatacccccagcaggtactggggcacttttttttttttaaagaaggggtgctatcttttaataaagcttttaaatatttttgccactaggtagaaggtatggatattgataccgattgtgataaagactataagtaacttcacatcatttcaggtcaggcattgctgccaaatgaatcatgaaaaagattctattttcaaagatttaaaaaaatttcacaagtagataaaggaatgatgatgggcttactgtattgtgaagatcattcagcattgatggcccaaagaatttattgcttcatacagaccctggaataaaagttttcaaattgtgttgccctgagtacagtctacctttgctgtgattattgcatcagatttccttaaaaaacacgtttgactcttccctgcaaacaagtttaatcagaggaagatcactgccaccatcccaacggaagaacttctgccactcgtgtttggatcctttccccaggcttcaaggttggccttctgttggaatcactctgctagttgacttcttgtgagccatcatgtgacgtgggaaatagaattccacctgagccatactcgagcttctgagttggagccaggaagtcatttatctgatgccctggacaacatgaagccaacattctggcctgtggccctcgtggcatcagcatcagtggctggatggagagcaggggcaggagggattgagggctgaagaaccacagtggccttgtttctgtgtcgtgtgcactccaaacttctcccagcccaggacctctgtgccctgcttcctggaacacacttccttgtgaatcctaaagaactaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttatttatttacttgttctttatttttttttctgcacaatgcaaagtcctttctgactcattgacaggacttttggttcctggagcagtgcctggcatatgacagggctcactaaacctttgtggggtgcgtgaatgccccttgcagtgtcaccagttcccctactttatagtgcctccctcctcccccatcttaagaccccagtgtcccttttgtgacatatgtcccagaagaaaaagtattgcaaatgtgggaaacgtgatagagcatgaagtgtggtaggatattaaattagcttcataaactgtgaatcataaatcatggttccatctgttttgtgacagagtgaaaacagcaaaattttccacaagataggaattaaaaacaaagagaagccccaagttttgactcatggagagcctgttactattattttggatcctcctctctctccctcattcctctgcaaccacttcagtcatgctgtgcgtttctgaataagcccaggaatctgcgtgtcataggccttggtttctatcccatagcgccatacctaacacctagaagccattcaaaaatgacttgttggctctcaatggtaaatctcactattccagatttattcttttgtgtcaattatggtatttttttctaaaacgaacaaaacaaacgaaaagatcctttgaacaggtgacctacaaaagaaagcccatttacaatctcttgttgattcaatgtcattgatgggttatagcgcgcagagtagttttttaaacatgagtcatttcttgagcagaagaggtcggggtggtcacaggcagcacaagggcacaggttgtcctgagaagagatgggacatcagcaggagacggaggaatgaagagtcaccaagacaactggttcatattacagttttgcctgaggccagcactgatgaggatgctgttctgggagacttggtgcctttgaattatgccgattggctaaatgtatggtggaggcaggaggtcaccaggacatcctgggaccaaccaaaccacagttttatcttggggaaattgaattaaaatgaacgtcaatacacagatgacatttctgacaggcttcccaagaaaccgatgcttctggagagggcaaatgatgggtggtagtgtagtgggcgggtctgcagggttttgttctcctcttgagaaccctttctagatttttttcccatttttaatgttttattggtgtatacttccaatgttttctagaattttaattttttccccatgacagtgtattggtttcacaattacaaattttaaaaaattaatatcttgaaaagatttcgctatattaaaatgctagttgaataaaaatgaatatcacagcaattataataaaataatactagggggacatca

SEQ ID NO: 92 - DNA, 7863 bp, Artificial
  ss725 sequence
aaagtcctgttagctcaaataacagctccttcaaagtgcagacctgaaccccaaaagcctgttttatctggggaaccagagaaatttcccccaccttatgcactgttgtactcccctcccactgctgcccaagttcccagaagccaaggctacaccaggagtggctgtctctcctgggggtagcccctcccccagcagcccctcccctgactcgcccatgacatcatcagtagctgcctctcctgagctgcgggtgttaaccccatgtactctggtcgaaaggcagctgagaagccggaacagcagagacagcccctccccactatggtgctggggagccctacaaatgccactgagggaaaccagagggccggtctattttaatcaagatggtcaaattcaaggaggccaatacggttttgtgtaccaaccattcaccaccactgacctcctcaattggaaaaatcgtactccttcctacactaagaagccccaggctatgattgatctgatgcagtctataattcaaacccacgagcctacctggactgattgccatcagcttctcctgaccctgataacatggaagaacagtgacgaattactcaggcagccttgagatggctagaggaaaacaccccagctgggctagcagatccccaggcttacgccccggcccatttctctgaggaaactcctcactgggaccctaacgacattcaaaaattacagaggcttgagtgttatcgtgaggctcttttaaatggcataaaagaaggggagggagggagggctatgaatatgagaaaaaccacagaggtgcttcagggacctggagaaagccccagtcaattttatgagaggctatgtgaagcattccacctctacacctgctttaacccagaggctgccgagaatctgcaaatggttaattcagcctttgtcagtcaggttcaaggagacacatggaataagatgaaaaagttagaaggctttgctgggatgaatgccagccaacaattacagattgcaacaaaggtgtttgtcaaccgggatcaagaagcccaacaggaggcagattggaaaatgaataagatggatctactcgctgctgctctggtggaccggtcagaacactcccggggatgtgcccttcagggcccagggccgggtggaggaagaagctgacaaggaggaccacctcacacgagatgagactgagacaaaaccaatgtgcttactgccacctagaggaccactggaagaataaatgcccccagcagtcagaggattattatccaacttctggacagagagggagaggcagggcgattcagggacaatgccaacaagtccaacaatcatatgaggcccctgagagtgattttgttggtctggctgttatggaaaactggggggaagactaggacagactgggctccattctgttaggtccctaggagcccatggtccaaatgactgtagggggccagcccactgatttcatggtagatactggggcagaacatactgtggtaactcaacccgtgggccccctctcatggaggccaccattagggagccactggtgaccagatctgttacccttttctgttacctcagcaatgcaatctgggtggccgtgaaatgatacacgaattcctataccttcccagttgccctgtggctttgatgggtcaggacttattaggaaatttacaggcctggatgggtcaggacttattgggaaagtttttcccatggccaaacagccctgactctagggaagtcaggggcaaagattatgactcacacggtcccccgagaagaagagtggcacctctacggccttgcagggaggtcgcaggaggggcacaagcttccttttcagctacctggggtatgggctgaagacaatccccctggactagcctggaacatacccccaatagtggtagaactaaaacctggggtcaatcccacccgcaaaagacaatatgtcgttctttgcagagcacaaatagggatccagaaatatttggagaggcttctaaaatatgggatcctccagccctgatggtcatcttggaatatgcctctcctgccaattcacagaccaaggacagatgaccaccggccagttcaaaacctacaagcagtaaaccaagccatcgtgaccttacacccagtcatccctaacccttatactctcttgagccttatccccactgaagctaccttctacacatgcccagacctcaaagatgcctttttctgcatccacctggcccctcagagtcagccaatttttgccttccagtgggaaaatccagagaacagtgacaatggccagctgatctagactaggctgcctcaaggatttaagaactctccaaccatattgggtactgcattagcttctgacttaaggaccttcccagcagacctgtatggctgtatggtgctccagtatgcggatgatttgttactggccgcacaaactcaggagagttgtatggaagggacacacgtatgctcctcattcttctatgggaggctggctacaaggtttcaaggaaaaaagcccaaatcttccaggagaaagttgaatatcttggctttcacttaaccccaagataaagtcaatttggcagtctgctctttcccagtccccttcacccaatgtcaggtcagagaatttctcagagccacaggtttctgcaggatctggatacctaacttctccattttgacaaaacccctttatgaggccacaaaggggggagaatgggagactttgttgtgggaatgagtacaacaaaaggcttttgaagaaatcaagtgagccctagccaatgcacctggcttggcactaccagatatcgccaaacttttcttcttgtacatgcatgaacacacggggggtcgcaggaggggtcttaactcaaatgctgaggtcatggcaccatccagtggaatatctttctaaacaacttgattctgttgtccagaggtggccgccctccctgcggacacttgcagcagaacactcactgtcagaagctaataaattgattatgggacaggaactatcagtccatgtgccacattcagtgctaacattaatggaatataaaagaaaatactggctgactaatgcctggatagtcaaatatcagggaatgttgtgtaaaaatccatgctttcacctggaggtagtgaagaccctaaaccctgcaaccctgctgcctgtcaggctgggccagccagatcatgactgtgttgaggtcatagatgaggtatttccagccaggtggatttaacagaccagcccctctaagacccagatgctaaatatttcactgatggtagcagttttataaaagagggagaacgccttgctgggtattctgtggtgactttacatccaccattgaagcaaaggctctgccaaaagggacttctgtgcaatgggcagaacttgtcatgctaatctgagccctccaactggcagcaggaacacacgtcaatatatccactgactccaaatatgccttcaccatcctccatgtacatggggctttatataaggaaaaggggctaatcaactcaggagggaaagatataaagtattgcaaagagatccttaagggtggcagttatgcactgttggggacatcaaaaggggggatgccatagtcactcgggaaaaccataaagcagaccagaaagaaaaactcgcagcctccaagggggacaatagaatgagtggccctgacagccacagtgttctctacgccactggcagaatgggacccaagctactcacagcatgaaagtacctggttccaaactgaaatgggaaattacctcccaggtggatggtggatatttgaagatggccaagttgcaattcctgaggccctggccccagcctttgttaaacaatttcataaggagactcatattggccagatagctctcaagactacattgggagttcccatcatggctcagcagttaacgaaactgactagcatccatgaggatacaggttcgatccctggccttgctcaatgggttaagaatccggtgttgccgtgaggtgtggtataggtcagatcccatgttgctgtggccctggtgtaggctggtagctacagctctgattggacccccagcctgggaacctccatatgccgcagatgtggccctagaaaagagagaaagaccaaaaaaaaaaaaattacatcgagccaacacttctacatccctcagctttccagcatagcccaggtactatgtgaacagtgtgagacatgtgcacaaaataactcacaccaggggcctagggctgcccctgggatacaaagtgttggaggggccccattggaaaatgtggttgaggacttcactgagctcccccgggtccaaggctataaatacctgttagtctttgtgtgtacattctctggttgggtggaggccctccccactcacacagagaaggtacaggaggtggctcaattcctcctgaagaaaatcatcccctggtttgggattccagccactatcggatcagacaacagactggcatttgtggtggaggtaatacaattggtagcaaaggaattaaatatcacctggaagttgcacacagcttatcagcctcagaactctgggaaggtggaatagatgaatcgaactctgaactgcaattaagcaaactggccaggagacacacttatatggggaccagctcttgccagtagccttgctaagaattaggtccagcccttctaaacagactgggctttctccttatgaaatcctctatgggctccccacctcctctcattaagtgtgtaaggggggaattaaaggaattagggaacctcactctgagacagcagatacaggtgctaggttccaccctggccacccgccatcagtgggttagggaacagttgcctgtaagtctaaccacagacagtcaccccttcgaaacaggggatgctgtatgggtgaaagaatggaaagcccagccattaaaacctctttggaggggcccatttagggttattttatccaccctactgctataaaagtggcagaaatggctccttggattcaccacagcagagtaaaaccagcatcacgagactgggaatgcatccctgatccctcaacaccatgcaagctgaccatctgaaagaagcaggctgcagcttcagcgacccacaaggatgacagcactgctctagtcactccagaggctgactggtctatgtacggcagaagcttgaggaatcagccaccagatgggataaatagactgtgtccattcctcatttcagtccccttattgcgatgcactgccaccccttgtacctgtctgttattgtggtcattgttctaatctttgccacggggctggcagcaactgctctagctggctggagttttggcaaaaggttcttacttgcactctgcttcatattctgggtaggatattttgttgctattggttgcttctaatctgggccctttttgccaccttagtagactcaaattccacccctcttgataagtgtatggaaaagatttggaatcaggggaaggttgggtcatccttcacctcctacacccaccagccagctgtttgttattgaggtaacacccccaccttttcacatataatggtaaaaggtattggataggatgaataaagacagaatacctagaggggcacacttgccagggaccaaagagagggcaagcaggggcttgggcccgttggacatatagtggacattggggcatgcatgtccagtggagggggagttcaagattgtgcccaggccaagctagtcagagaaactacacagaaaaaaaaagaaagaaagaaagaaaaaaaaaaaaacaggcaggttcaaggcccctgcaattggggtccagcccaactcagaaaggacctaggtccagactgggacttccccaccctagggaagaaccttttcattgacctagctgagagaatttctcatgagttcagtgtcactaactgttgggtctgtggaggggcccttatgagtgaagagtggccttggagggggaccagcctagatgtactccatttacttcaatggagttattctataacagagagaaaaaacaacgagcctcaaagctgggtcttggcctcagaggtaattggagaggagtgcattagtagaacaggacacgattatacacaatgggtaggagaaactccatgtaaaagaagactttcttgggactctatcaatttcaaatggtggccaaatattcctacctggtattgggccctggcctccatggttaacaattcccagtgtcaatcctctccctatcaagccatagtcaattgtataatatatacttaaaaggagatcaatccattctttggcatacctggaattagttatctgagacagcctcactcttagtgaccctgaacactggagggaaactgatgggctgttttggatatgtgggaaaagagcatatacacaactccccactctgtggaaagggagttgcactattggaataaaccaaccagaatttttcctcctgcccaaccaggagggagaaaagttatgggttcccctttatcagagcctaaagattaaaaagagaagtcctacgcctgggggacaataaaatggggggaagaagaatggccaccccagagaattattgagacatatggtccagccacttggccacaagatggaagttggggctaccaaacccctatatatatactcaatcaaatcatcaggttgcaggtggtactggaaataattactaaccaaacagctacagcccccgaacccatgacaaaacaacagtcacaaatgcacacagctatttaccaaaactgcctagccttagactatctttagccaaggaaggaggagtatgtggagaatttaaccaatctgactgctgcctccagatagatgacaatggccagtctgtaactaatatagccataaacattagaaaagtggcacatgtccccttacaaacttggtagggctggtaccatggagagcaatttgggggatggttttgaacctttgggggattcaaaaccctcataggtatagtgctcatgatcttgggaggctacctgatcttaccctgtctggctcctctagctataagatctgtctctggactcattgagttgggagaaaaacagccacacacatgttgatgctgtggaaatataaacccctggcctgagatgatgttctttgaccctgggaaagggatcagagcatcaaagggggggaaatgcagtgggaaggggacagggccctcccagatcaaagggaaggcaacatgcaatgccagcatttgtgcacacatgcacggttctgcagtaatgaagcataacctatatccatgggcacaggcacatctatagctgtctgctcaaaatttatagtattcctgataagagacaaagaaacttagatgtagcaggaaaactagcagggtatataaggcagtgtcccactgcattcagggctcagcctctggatgttaatccgctgagccagtgctggcacgaataaatgctgcttcctgataaaaagccctggtgtcttgtttctctgtgtgttaagtcctgcaacaatctgagagcagagcagtcacagaaagatggttgaaagtattgcttgggtctgcttccattttatgtttactgttgctacaagctctgcctctatttcaatgttcccatcttgtgttccttgaagaatctatatcagaaccctatcttggaagagagtaagagagagattg

SEQ ID NO: 93 - DNA, 4444 bp, Artificial
  ss688 sequence
tggaaaacccccttattgcctgtaaagaaaccagggacacaagactcccgcccggttcaggacctgacggccataaacgaggccacaatcatgttgcacctgtctgtgcctaatctgtacacggtgctgggatggagcccttccactgtcgaggggttcactcgctggaacttaaacgatgccttcttctgcctccaagcggctcctgctaggtgtcccctttttgcctttgaatgggaaaatccacacactgggacaaaggagcagctcacttggacaagactttcacaaggattcaagaactctcctgctgcaaacctggctgaatttttgggacaaaactagaatgtgtcttgctgcagtatagtgatgatctcttgctggccagcaccgtgcaggctcaatgcctagaaggagaaaaagctctcctctccctactaatggaggttgggcatcgggtatcaaagaaaaagttgcaaatctgtaagaaacaagtcaagtatctgggctttaacattacgcagggccaacgaatgttggggactggcagaaattacaccgtttgtgccatcccagtccctaccacccacgggaaggtttgtgagttcccaggggcagcgggatcctgcaggatatggatccccaggctttcagacttggccagacttctgtatgaggccctagaaggaggagaaaaggctcccctggaatggggaccgagccaggaggcagcattccagacaatcaagaccaaacccactgaggctctggccttaggactttctgatgtaaccagagaattcaacctctctgttcatgagaaaaatggaatgggcttgggagtcctaacccaagaatttgggacttggcagaggcacatttctctaagcaaattgactcagtttcagtcggatggcctccctgcctctgagtgctggcagttccaccttgttagtaagggaggctgacaagttgactctgggacagaacctcaatgttaaagtcccgcattcagtcgtaaccctgatggacaatcggggctgccattggctcacatatgcacggatgactcagtaccaagggttactatgtgaaaatccatggataaagctggaagttgcacaaaccccgaacccagacaccttcctacccgatgaagcgggggccccagaccataatttcttacaagtactagatgaggtgttttccaccaggcctgtcttaactggtagacagctccaaaatccagacctagttctatatactgatggcagcagcttcacggagggtggaaaaaggatggcaggatatgctgtggtgtctgatccagaagtgatggaagcagaggcacttcctcaaggctggtcagcactgagagcacaattatgggcattaatcagagcgctggagctcagctgagaccagcgagttaatatctatgccgacgcaccgtatgcctctgcaacttcacatgtccacagagccttataaaggaaataggaagccttactgcggaaggaaaagggatcaaaagccaagccaaaatcttaaagctccaagaggcagtatgggaacctcaagaagtggtagttatccattgcaaaggccaccaaaagggagacgatgtgatggcaaaaggaaaccgcagcattgatgcagacgccagacaagcagcccggaggcaaccaccagacaaacccaaagacctgatggccccagaagtgccaattgtccccaggtactctctagaagaggaaaaggggataaaagaggaaggaggaaccacacctaagacaggatgtgggtcacacaggaccaccatgtttatgttccagaacagctggtctacaaactgtccaccagcaacacaaactaacccacatgggcaaaactgcagagaccttactgggtcaacactacctcattgcacatcttcccacactctgttcctccatctcccaacagtgcataacttgtctacaaaataatgctcagcaggggcctagcagacccgctgggacacaacactgtgggctgtccccatttgaggatatggacgtggacttcgctaaagtcaccccaagcagaggatacatatacctgctagtttttgtctgcaccttttcgggatgggtagaagccttcccaacatgaactgaaaaggtaagagaagtaaccaaggcactcctgagagatcattcccagatacagaatgcctctgactatcgggtcagacaatggacggcatcgtggctgagacggtgcagcaggtggcaaaagccttacagatccagcagaagctacattctgcctatcgccctcaaagctcagggaaagcaaaatgcatgaaccgaaaccttaagcagactctagcaaagttatgtcaggagactggcttgccctgggtagatatgctgccagtggccctcctaaaagtgagatgcttgctgagagcgaggataggattctcgccatttgaaatcttatatgcaaggctgcctccactgatcagcttgagaggaaccaccagagaactgggagacttaggcttacaaaggcaactgcaaggattggcactccccatctcacaaatacacaaataggtcacagatggaatgcctgtatctctgggctcaacagtgcacccccacaacctgggggaccaggtatggataaaggactggaagaaggagcctttaaagccagtaaggaaagggccctatactgtagccacccccactgctctcaaagtaacaggaacagacacctggatccttctctccagagctaaactggctgcccaactaatgactgtgaggacggagagctgcccttgacccggagaaagcgccacgcctgccaatgcagaggaggagacaacaactccgtgctctgccctgcccacacaggaggctgggcagtcaacgcacggctgaagctccaggaaccggctgcccggagatgcttgttgtgtgctcttaatctggtcccccgaccctgtcaggatccattctgatgggtgcagatgtaccctgaacatcaagagagggggaggaagtaagagttttaactagagaaacaatccctgcctaaagaggcagctaagcgcctgacagcagctctgctcgccccaaaccacccttcttgtcaccttgtagcaactatgtgccttatgtcttgctagcagctctggtgcaccaagcactgctcatcagtttccttcttgtaatcttgtttactcagcttcttaggcaggaacacagtctgtttggggaagcggggggtggggggggtgccaggctgcttgcgcaggagaaaccagacctggaagcctgtattatagaaaagatacacaggacgaagccttggtactcagtctctggaggcgactgctctgagcccacaccggtgctgtgccaaataaacctggctattccacatctccgagcgccgctggtctctttccgcggccacggtttctgcaacagttccacaggggaatttctttttgtttccaatttgtaatcccaaagaaagagagtaacgaagccagcttgggtttcctgcctgctctgataggcaatcggagtggaaatgattgacaggatgaatgggggagtggtctcccacagaaagaacaattggaagaatggtgggcaacagcattgccgtgtatgttacactgactgtcagggcttgagccccagcacagctcctcccgggccgtgtaacgagggcacgtcacttaccttctcagtgcaatacctgtctaacatataaaatgaaagtaacgacagtagttacttcttagacttactaatttaataagggtaaaatattagaacagtctcagctccagagtaagtactaaagaaatattagtcatatgtaaacaaaattcttcttaccaagacaaagaaagcccattataccctgcttagtatttcagcatcatttcttgtcctgttcttatccagcatttccagcctatgctgagcaatacataccacgacacctcttgacccttgctcatgctattctctctccctggaatgcctttccctagttgtatcagcctaggtgccgtggaagtttcatttcaatattaaaatatttgtacttcaacttggtaatggaacatttaaatgttataaaaaatagtaaaaaaattatgattttttttttcttttttgggctgtacttgtggcatatggaagttcctgggccaagggtcaaatcagagccacagcaatgtcagatccaagatgcatctgcaacctacgctgcagcttgtggccatgtcagaaccttaacccactgagtaaggccaggaattgaacctgtatccttgcagacaccatgtggggttcttaactcactgagccacaatgggaactccattatgcaatactttaattgtcccccttaaggggtgaaggaaatg

SEQ ID NO: 94 - DNA, 3026 bp, Artificial
  ss761 sequence
tcagcagtcctccaggggcctcatgagatatcaagccaattctgtgagaggctatgtgaggcattccccctctttatcccctttgacctagaagcagctgaaaaccagtagatgatcaatggagccttcatgagccaggcacaagtggacatctgatgcaagctccagaagttagagggttttgcatgtatgaatgctagtcagtttctggggatagcaaccaaagtgcttgtcaacagtgaccactaaagcctgaaaaaaaaatgcaaaatatgtgagcccactggccactgccttggtgaagcaaatggaaggtgcccctcagggccaaggctaaggtcagaaatgagggcaacaaggaggaccatcatgcccagggccaaaactgggatggaaccaatatgcctgctgtccccaggaagaccactggaaaaatgagtgtccccacttgtcaggtgattcccaatcaggtgtcccaagtataggggaagatgctgggtggaccagggtggatataagctggcccaacagccacatggggccccccaaaatgatttgtagggctggctgttatgggagactctgaggaggactaggactgaccaggctttattttgctaggctcccaagcctgtgggctgaatgaatgtagggggccaacccattgacatcatagtagatactggggccgaacactcagtggtaaactcagccccctgtgggcccactctcacagaggcaagccgccatagtaggggccacaggcacccaaacatggtgccccttcctgcagcctagacgatgtgctttgggtggacatgaagtcattcatcaatttctatacctccctgactgtcctgtggctttggtgggttgggacttattggtaaagctacagccgcagataaatttcaactcccactgccaaatggtcctgaccctagggaacacaggggtggggcccatctgacaaaagcagtatttcatctcctgtaagtcccagatgggaattcaaaagcacttaggaaggctctaaagtatggaattatctggccttgacagttaactttgagcacgcctttcctggaggcctggagaacaggtaccaatgattaatggcctgtcccagatctatgtgcagtaaatcaagccacagtcaccctacatctggtctttcgaaaccctcacacactctgtgtccatctggcctcccagagtcaatcgatttttgccttcagtggaaaagtgctgagaatggtgacgagggccattgccttagaccagattgcctcaaggatttaaaagctcctctactgtttatggtaccactttagtgtctgatttaaaagccttcccagtggaccaacatggctgcatgctgctccaatatgtggatgacttgcggctggcggggtgaacacagaaataatgcattgatgggacacagcttgtccttaccctcctgtgggaggctggctacaaagtttcaagaaagaaagtccaactctgaagaaaaagtcaagtaccttggttttcacctgtctcagaaacaatagaaactcagcccagaaagaaaacaggctgtctgctccatcccggtcctgacgactagatgccagatctgtgagtttctaggggctgcaaggttctgcaggatctggatacctaaattttctgttttggcaaagcccctttatgaggccacaaagtggggagaaggagaacctctgtggtgggaaccagagcaacaaaaggcctttgaagcaatcaagtgagccctcgccaatgcacctggcctggaactcccagacatttccaagcccttcatcttgtacatgcacgtgcacactggggttgtagtaggggtcttaactcagatactgaggtcatgacatcatccagtgacatacctttcgaagcaacttggcgccattgcccaagggtggccacccttcctgcaggcactggcaggcagagctctcttagtgtcagaagctggtaaattggctataggacaaaaattaacagtccgagtaccacattcaatgctaatattaatggagtttaagggacaagaccggccaacaagaacgcccagatggtcaagcctcagggaatgctatgtgaacatccatgcagtggcctaaaagtcgtgaggaccctaaaccctgcaactctactacctgctgggctgggccagccagatcatgattgtgttgaaggcatggatgaagtattttccagccaactgggtttaacaggccaggatctcaaagatccagatgctgaatatttcaccgatggcagcagctttgtaaaacagggagaatgccttgctgggtattcggtggtgaccgtacattccaccattgaagcagaagatgtaccaaaacggacttgcaaacaaaagacagagctcattttgttaaacccagccctccagctggcatgaggcatgcatgtccgtatatacaccaactccaaatacgccttctccaccctccatgtacgtgggactttatataaagaaagggggcctaatcaactctggacaaaaggacataaaatagggcaaagaaattcttaaattcttagatgctgtgcaggcctctagaaaggtggctgttgtacactttcagggtcatcaagggggaagcaccacagtcgctcagggaaaaatgtaaagtaaaatgagaagcaaaactcaaagcctccaagtggacaatagaaccagcagctctgactgccacactgttccctggtccattggtggaatgggacccacaacatgaaaacagcaggtttaaaactgaaaatggaaaccacgtccctgggggatggtggaaaattgaagacagccaaagagcaattcctgaggacctagaccaagcctttgtcaaacaattcgaccaggagactcacactgaccaaatggctctcctcgacacactgggccaacactgaaaccacacaactctccagaagagcccaggtagtatgcagacagtgtgaaacatgtgcctgaa

SEQ ID NO: 95 - DNA, 8407 bp, Artificial
  ss795
tgtctgcttggggatgggagaggtccgggatgcttacaagggaaaatcaagaccttgtagtgtataaaagttactgagaacaaagacctggggctcagacgctggaggtgactcctctgagcccgcacgggtgctgattaaaccttgcttttccatatctccgagtgctgtttgtctccttccattgccacagtttttgcggtttctgcaacattttggtgcgttggccgggaagccgacaaccgagctggcctctgtgccaccgttgtcggggaaccaggggaggccatggtcgccggcccggtgacaggtggatagcgtgcaccagccattttgccggatccacaccctcactcgggccgtggccttggcccacactgcttcccgaacggacttagaaggagagtggaaacaggttccaggacaggacgtcagactggtgagtgccccggggacatctgcccaagtcaggacccaccatacggcggaaggagagactgatcacctctcagtgaccaaagggtcactcaggtcagggtttgctcccttgggatcgggaggcttgtcaatcctggtgtgtgtgtgtgagtgactgaagagaatcagagcccgagctccactgtctttggactacggagccagagtgagtcctaacatacagttccgcggcgaccatcatacagcttatggtggccctcttcggggggatcctgacgttggggtttatacagtcccacctatgctaagaggcgcctgaaatatctcctctgggggagcggtcagacggatgaagcaattgttacctgaggccttgccctcactgtttgtcctgcgtcaccggcacagggtgggactttacacaatgggtaaatcagcttccaagcccactgtcttagaatgtatggttaagaattttaagaaaggattttctagagattatggtgttaagctgagtcctggaaaactgtgtaccctctgtaccctagcgtggccctcttttggtgttggctggcctccagaagggaccttagatgtgttcacagttatagcagtatataatgttatatataacaggagaccctggacacccagaccaatttccatatattgatcaatggttggaaattgtctatttgaggcccccataggttcggttctgcaccacagaccagggacagtgtaaggtgctagtagtccagtccaagaagaaaagcttgtctcaaaaaaggtgccacctatttatcaaggggaacctgaggacttgccccccaatgccaccaccttatgtgctgccggccccacctccaggagccaaaggtccccagatgccagatagcccaccgccttctgtttctcctcctccttctgcttctgaagttcccaaggcaatattacccctgcagccagattctccagaacctatgagcaggcatctccgttcagctcagggagcagccactccagcattacaaatgcccttacgggagacatggggaccacagcaagtcgcccccaatgggaccattcaagaggggggacgtttttattattaccagcccttttccactgccaatctcctcaactggaaacaccatactccctcatattccgaaaagcctcaggcgctgattgatctcttagaattcattttccagacacactgtcccacctggatagattgccggcaactcctttttactctatttgacactgaagagcgctggcgaattttaacagaagcccaaaaatggcttcagatcaatgcggggggtcgagcagacttggcaaactgggtgagggaagacttcccagaagaaaacccccactgggactatgacactgaagaagggaaacgtaatccagagaggtaccggcaggccttcctacagggggcaaaagctggggctaaaaagcccactaatatagctaagatcagtgagatactacaagagccgaatgaaagcccagccaaattctatgagagactatgtgaggctttccgaacctacaccccttttgatcccgaggcccctgagaaccaacggatgataaatgctgcctttgtgggacaagcccaatcagatatccctacaaagctacagaaattagaaggctttgcaggagagaatgccactaaactgttggaaatagccaacaaggtttttattaaccgagaccaggtggcctgcagtgatgcagaaaagagaatgaaacaaaaagtgactcttctggcagccgccctgtcaaaaccggtgcccccagtgggaccaccccgtaggggacaaggcacaaggccagggaaaaggagtcccctggaacatgaccaatgtgcttactgcaaagaaaagggacattggaaaaatgaatgccccaaacgtcctgagaaaaagaccaaggccccacctagctggtactgatctgagccattcagcaccaacctgatcggcctagctgagtctgattaggggggaccaggctctctccaactgggcccccgagagcctatggtcagaattcaagtagggggccaccccatagactttatggttgacacaggtgccgaactttctgtggttacacaacctgtggctcccctctcagggaaagaatccgctgttgttggggccacaggtaaccaaacccacaggcccttctgcggtcctcgacgacgtcggttaggaggccatgaagtaatacatgaatttctttagctaactgactgcccagtccccctgctgggaaaagacctgctggctaaaatggggacacaaatttccttttctactgatggatcggcccaacttaaattgacagaacccccctctcctttaatcatggctcttgctgtaaaaagggaagaggaatggcgcttgtactctcccccttcagaaatggggaccatcccccagaactagagactaaatacccattggtttgggctgaaggaaacccaccaggactggcaaaacaccacgctcctgtcttaattgatctaaaacccggagctcaaccggtaaagctacggcaatactcaattcccagagaagctcgaatgggaatccaggttcacctggatcggctgcttcagcatggactgttaataaaatgtcagtccccttggaacacccctttactgcccgtgaaaaaaccgggaacacaggactaccgcccagtacaggacttgagagccataaacgaagcaacagtcacattacacccgtccgtccctaacccacataccctgctagggctgattccctccactgctaagtggtttacttgcctggacttaaaagacgcttttttctgccgccgggtggcacctgccagtcagcccttgtttgcttttgaatgggagaatccacatagagggacaaaggaacagctcacctggactagactcccacaaggattcaaaaactctcccactcttttcagcagcgccttagctgctgacctggctgaatttcctggacaaaaactgggctgtgttttgctacagtatgttgacgacctcttactagctggcaccacggaggctcagtggctagagggaacaagagctctcctttccctactgatggaggcagggtatcgggtaacaaagaaaaaggcacaaatctgcaaaaaacaagtcaagtatctgggcttcaacatcatgcaggggcgacgaatgctggggactgaaagaaagcaggcagtttgtgccattcctgtccctaccacccaccggaaggttcgtgagttcctaggggcagcaggattctgccggatatggatccccgggttttcagacctggccaggcctctgtatgaagctctaaaagggaagaaaaggctccccttaaatgtggaccaagccaggagacagcgtttcagacaatcaaaactaaactcactgaggctccagccttgggacttcctgatgtaaccagagaatttaacctttttgttcatgagaaaaatgggatggctttgggagtcttaactcaagaatttgggccttggcagaggccagtggcatatctgtctaaacaaattgactctgttgctgccggatggcctccctgcctccgagcactggcagctaccaccttgttggtaagagaggctgacaagttgaccctgggacaaaacctcaatgttaaagtcccacactcagttgtaaccctaatggataccaggggccaccattggctcacacatgcacgaatgacccactatcaagggttactatgtgaaaatccacgggtaaaactggaggttgtacgaactctgaacccagccacttttctgccagatgaagcggggcccccagaccataactgcctggaggtactaggtgaggtgttttccagtaggcctgacttgactgataaaccactccaaaatcctgacctggttttatatacttatggcagcagctttatggaggatggaaaaaggatggcaggatatgctgtggtatctgacttaaaagtgatagaagcagaggtgcttcctcaaggctggtcagcacagagagcagaattatgggccttaatcagagcactggaactcagccaagaccagcgagttaatatctataccgactcatgatatgcctttgcaactttacatgtccatggagccttatataaagaaagagggctcctcactgctgaaggaaaaggaattaaaaaccaggctgaaatcttaaagctcctagaggcagtatgggaacctaaagaagttgcagttatccactgtaaaggccaccaaaagggggatgacccagtggcaaaaggaaaccgtagtgctgatgcagctgccagacaggcagcccggggacaacacccagacaaacctaaggtcttgctggccccataagtgccagctgtccccaaatattctccaaaggaagaaaaatggataagggaggaaggaggaactaaaactaaaacggggtggtgggtcacacaggaccaagtttacattccagaacagctggcctacaaactagtctgccaagaacatgagctaacccacatgggcaaaactgccttagagaccctactgggccagtactatctcattgctcgtcttcctgcactctgctcctctgtctcccaaagatgcataacctgtttacagaataatgcccgccaggggctccacagaccagctggggcgcagcactgcggactgtccccatttgaggatatggaagtggactttactgaggtcacccctagtaaggggtacaaatatttactagtttttatctgtactttttcaggatgggtagaggccttccctacccgaactgaaaaggcaagagaagtaaccaaggcactcctgagagacattattcccagatatggaatgcctctgaccatcgggtcagataatggaccggcatttgtggctgaaacagtacaacaggtggcaaaagctttacagatcagatggaaactacattctgcttatcgccctcaaagttcagggaaagtagaacgcatgaaccgaacccttaaacagaccctggcaaagttatgtcaggaaactggctttccctggatagacatgttgccagtggccctcttaaaagtgagatgctcaccccgagcgggaataggattctcgccatttgaaatcttatatggaaggccacctccactaatcagtttaaaaggaaacaccagggagttgggagactgggaattacacaaacaattacaaggactggggctcactatttctcggatacatagatgggtcacagacagaatacctgtgtgcttaggtataacagtacacccccacaagccggtggaccaggtatggataaaggactggaaaaaggagcctttgaggccggtatggaagggcccctatactgtaattctaaccacccccactgctcttaaagtaacaggaatagatgcttggatccatcattctagagtaaaaccggctggcacagctgaggaccttggagagtgggagactgccctcgatccggagagacctcttcgcctgacaatacagaggagatgacgatctcaaagccctgctctgaccacaccggaagctggtcagtcaacgcacggctgaagcttgaggaatcggcagcctggtaaaataaactgccttacctcccttccacaagagattctctaactgtcatatactgttatcttatgaccaacctgtatgtttgctgcctgttgctgttaatctggtcccctttggttctgtcaggatccatgtcctcatgtgacccgtgcattcgagtgacccgatcagatcaaggggttacatggactttgctttactccactcatttctcctgttccggagaaattcatggaagctgtactcacaacaggaccacttattctatctgtcaacagggggaccacctggaacgattgcttggaatgcacttactggagctgtgtggcctgggcaacctggaataagggagacaaaacagctgtccttcaaaagggtacagcccctccagactgccagactaaagcttgtaacccagttaatttcactattttcaattccagtgagcccaaatggaaggagggtttcaaaataagcattcgcgttgacggaagaggccttgaccctggagctgtgttacatttccagagaatcacgtttgtgctccaagctgcctctcacagcgtctttcattccttttatgaagagataagaaacaccccacctcccattccggccacaactaagaacttgttcttagccctggcagaaactattgcacaaactctcaacgtctcctcctgttatgtatacgggggaacaaacgcaggagaccactggccttggcaagccagagaactggacccattagagcctcataatgagactgcatacccccaactcaccaatggggtatggctcctcagaactgctattatagggagaaattgtcttgcgaggcggggaggatggtttaatgtttcactaggaagcttaacatgtttaggcctaaggtattataatctgactgcccaaaagactcaatggtggccatcctccaatcgctcagagcccaagtctaacttttcccaccttcgacaagcataggaagatatcagtactgatatccagtggcgggcaccaaagggattatattggatttgcggaaaaatggcctattccatactccccccaaactgcgctggggcatgtgtactgggaacaatcagaccttccttcttcctgctcccactgtcattaggggagcaactgggagttcctatatatagggcacagggtgcccagagagaccggagggctctccaaattggagactggaaagatgatgaatggcccctacaacagataactcaatattatggacctgccacctgggcagaggatggctcttggggatatcgcacccctatctatatgctgaaccgcatcatcagactacaggtggttttggaacttataacaaatgacactgcaagggccttgactatattggcccaacaacaaactaaaatgcgcagtgcaatctaccaaaatcgcttggccttggattatttacttgcttctgaaggaggggtttgtggaaaatttaacttaagtaattgctgtctacaaatagatgataccggaaaggtggtagaagaaattgctgactacatgactaaactagcccatgtacctgtacaaacttggaaaggatgggatgcagacagtctctttggtaaatggttctcttggttgggaggaattaagacaatggtcggaatagtcatggttatactcacagggtgcctacttgttccctgccttgtacctctcctgataaatattataaaaggttttataaaaaccatggttgaaagaaaaacagcctcccacctgctacttattagagtctaccaaagggttatgactgatgatgatctataaagggtgcagatgcaccctgaacatcaagaggggggaataaaatggagttttaaccaaagaacaaccccctcttggctaagaaggcagctgcaagcctttccagctgtgctaatcactatgccacccttcttgtaataatgtaacaactgtgtgctctctgtccaagccagcagccctgctaatcatatacgcaacattgcttatcagttctgcttctgtaaccttgcttgctcagtttcttagggaggaacactgtctgcttggggatgggggaggtccgggatgcttacatgggaaaatcaagaccttgtagtgtataaaagttactgagaacaaagacctggggctcagacgctggaggtgactcctctgagcccgcacgggtgctgattaaaccttgcttttccatatctccgagtgctgtttgtctccttccgttgccacagtttttgcggtttctgca

SEQ ID NO: 96 - DNA, 8008 bp, Artificial
  ss811 sequence
tgtgtgcattttttgagcacttgcgcccttctgcaaagtagagccttgttgagatctccccgcgttcgtgtgtcttacttcctgacactgacgatttgagccagtcacttttccccaacaatttggggggctcatctgagatttgggggccactgaagcatggattctcgaggaggggagacgtgtcccatggccccattgcagcagccctgaattgagagggccacttgaacatcaaacgcatggagggttctcgacaacacgggaggacagtctaaagaaaagggcaaccaaggcgaccagctgactccgtgcatggaccaaagtaggaaaggtagagttgtgggggcaaccgagtagttccttggtggtcggggaaagggactggtaagcctcaaaatgtcccgggtgagactggcaatttcaggtgaaaccagagaatcagagcacaatcccaggcaaataggaagtaagtcttcccaacccacacctccactcggaggatctccgggtggagggggaaaccaaattcctccaggcagtcctctgggattaatgttaaagtattggggcgacaatccatggatgaaggacaaaaagaagggaagaatgattaaatattgctgttttacctggacacagactcctattctcaccccatccatcttctggccaaagtttggatcagacgaggactgagtctgccagcggctcattcagtttgtccagacaccgaggtcgcaggaggaaactaactaagctctctgttggcagcagggaccggttgtcttatttcccctcaaagcatgggaacagaaaggaaatgagggggaactgaagggaaatgaggaggaaacccaagaacgttctgcgacttcctcccctccaagggaatcccttgactccctgccaccgccttccaacctccgaaatggcactgccctcaatcccgccacagccgccacccactgcagctgcgcgtagccccggagggagaggggagagaggcccagggcacaggcgcaagcgcccacacggtcagagcccaccgcctcaaggaaaccaaaggatatgtcagggccttattccagactcaggtgagagttaaaacaatgtcaggaggatattcaaaactttccgcttcctatcgctacccctggggacggacaagaagagccgcaaccactattcccagtacggaggttcccttgggtgggggcggataggatatgtaaatgcccctttaaccagcactgaggcccaaaattttagagggaattgtggcccttgttggaggatccattcggggtagcagatcgagtggatcttttccttggaccacaagtcgatacatggtctgaattaatgtctattttgagtattctattttccagggaagaaagggggatgattcgaagggcagccatggcctcgtgggagtgaacccacccctccccagcccagggaaggttcaggcagaaagtaaatttcccaatgaggcccccaggtgggacggtgataatgctgcacagcgggggcatatggtagacttgagaaatctcataattcagggaatcagaggggccgtacctcagactcaaaatgtatctaaggcatttgaagtacagcaaggtaaagaggaggggccagctgaatttttggaaagactcagagttcaaatgagaagatataatggaatagattccaccaccgtccctctaggacagggcatactcaaacatcattttgtaactaatagttggccagatatttccaaaaagttacaaaagatagaggattggaaagataaacctttagagaacttactaaaagaggaacagaaggtttatgtgagaagagatgaggaaaagcaaaaacaataggccaaggtcatgtctgcatatcaacaaaaacaagacaggtcaaatcaaagggtccctggggcaaaaataagagaggtcggaagatcgggcctcatggctacccagaaacggaccttgatgaaaagggaaacagatggcagagtgaaaacaagtgctttaagggtggcaaattgggacatttcaaaagggaaggccctgaatgggaaaaagagaaaaaaaacaatctctatgatgttgtttgaagtagatgaagactagggggtcagaggctctcattagctattgaccaacttaaaaatccataggtgccctacccagagcccttgataaattcagaggtagggccataccatgaaactatgatctttcttattgatttaggggtgtcccacccctcgctttgttatgtgcccaaagggctttctccttcttgcgaacaaatattagtatctggagtaaaaggagagggattttcaacaagaatttcagaagaagccaaagtaaatttccaaaacagatgtgctaaaacaggcttcctttttgttccagagtcaggcacaaacctgtgaggaagagacttaatggcaggcctgggcttacaggttaccaaaaaaactttacaagtaaaactgaatcttctaaccccagcggtagagggataaattcaaccacaggcgtgggcatcagagggaaatcgtgggggacttaaagtgaccccaattaaaatgcagttaaagaccccgggagaagtagctgggaaaaaacaataccctgtccctctacagggaaggatgggacttaaaccaattatagagggactgactccttcaagagggtctcctagaaccttgcgtgtcttcctacgacacctctattcttcctgtatgtgagagggatgggtcctatcgcttaggccagcatttgtgggcaatcgatcaaatggttaagactaggcacccaagggtcccaaatccttataccctcctgagtaaaattccatttgtccacaagtggttcagtgtaactgacttaaaggatgccttctgggcatgccccttggacttggatagtcaggacctactcgccttcgaatggaaggacccagtaacaggaagaagacaacaatatagacggacagtccttcctcaggggtttacagactccccacatcttttcagacaaattttagaacaggtgttgggagaatttacaccccctcacaggacctgtctgctctaacatgtagatgacttgctactctcaagcagtgatcaaaagaaactttcagcagctatagtttccctcctctcttttcttggggaaaaaggccttagggtctctaagaagaagttacaatttgttgaaaaagaggggaaatatttgggacatctgataagtggggggaaaagaactcagcccagaaaggatagaggggatcataggcctgcctcttccagctaccaaacatgagcttagaaagttcctgattggatattgtcacctttggatcaattcttatgcattaaaaactaaaaatttatactccaagcttgcagaggaaggccccaatcccctactatggagccaggaggaggtacaacaatttagggatcaagggaggcactgacgggatgcccctgttctggctcctccatcctttgaaaaaccttttcatttatttgtaagggtggaggaggaatagctctgggggtcctcacacaggaacatggggaagccgccagccaacggccttcctttcctgcttcctggaccctgtcgccagaggatggcctgagtgcatacagtcagtagtcgccaccgccctattaaattaagaaagaagaaaactcactttgggaggaagactgaccataagtaccccacagcaggtacgagccatcctaaaccaaagggtaggaagatggcccactgactcccaaatcttaaagtatgaggcaagcttattggaaaagaatgacttaactttaaccactgatgaggccttaaaccctgcttcttttctctcccaaatggagccctcaactccaattgaccatccattgtttaaatttagtaagactatcagcccaaaccttgaccccatctatgggaaactcccttcatttcggggagacacttattcattgatggatcttctcgttcattcaaggaaaacgacacaatggctactcaactgtcaatggagagattcaatcgataactgagtcaggaagactcctgaatatacggtcggctcacatttgccaactctttgcccttaaccaggccttaaaatacttaaaaggaaaagagggcacaatctataccaactctaaatatgcctttggggtggtccatacctttagaaaaatttggatgaaaagaggacgaggacccatcaacagtaaagaatagagaactaatcaaacagatacttgacaacctccaactcccagaagagacagtggtggtacatgtgccaggctaccaaaagggggtcttatttgaagctcgaggaaactccctagcagatgaggaagccaagagggtagcattagaatcagaggtccccatcgcccatcttactccctcccttcccaaaataacaatctctccctcctttttagaaaaggagaaggaacagctacatcagctgggggctcagcctgaggctcaaggaagatggttgctcccagatggaagggaaatgctctccaaacccctaatgagagaaattatcacatccctataccaagggagccactggggaccccaagccatgtgtgacacagtcttaagggtctatgggtgcgctggtatttacacaatagccaaacaggtaatagaaggttgcttaaaatgcaaaaagaccaataaaaagactttacagaaaagaactaccagagcaaggtctcccagttttaggcctttccaaggtatccaaattgactacgctgaaatgcccaaaatagggcaactcaaatatctctcaatcatagcagaccatctaactcattgggtggaaactatcccattacccagtgccacagccaattacgtgacaaaggccttattagaacaaattattcccagatttgggatggctgaaaacatatattcgcataatgaaagtcattttaaggctcgaataataaagagactttccaaagaattagatagtaaatgggaatatcatacctcgtggcacacccctcccccttgtctggtcaaattgaaagaatgaaccaaactctcaaaattcacttagctaatactagaaacccggctaccctggaccaaatgtctcggtattgctttactcagaattagaactgctccccgaaaagatgtcagttcctctccctataaaatgttgtatggacttccttatctgggtagatcatctgacctgcctacctttgaaaccaaagatcaatttttaaagaattatgtgcttggtctatctttcactcttcattttctcatacaaaagggattactagcccagactccaccgcttgacttcccggaccactgacatcagcctggaggctatgtgttaatcaaatcatggaaagaagacagactccagccaacctgggagggaccgctcctcgtgctgctgaccaccgaaactgcagttcgaatggctgagcgaggatggacgcaccacacccgggtgaaaaaagggggggccataacagacaaaaagcaacgagtgacttttccagacaccaccaaaacccagttggtcctaaaaagggtttaaacttattcatgacatggattactatatggggatcattaatgtctggtagtcaggatggatcatgggatcctctaaccccaagatattactggagcctgcgattatgggcaggttatccacccatattaattattaacttaacccagactcctaactcagtagtcataaaatttgatgcttgtcaaagtcctagactatggaactctagaaagtcaaagacaactctcatctgtagataaatatctttgtccagaacttagtccacaagaactgtatacacgaggggggaagacgggagtataagtacctgggatgatgtctggtggaccacccaacacaaggggtgacctctccccatgctcgtaccttacaagcatcaaaggacaagatttacctctcaaggggagagcctccaattaactgtacccacttaacatgtaatccaatcttactatcaacaatccaaccaccctagcccagccaccagaaggggcaactcgtatatatggtttaggagctgatgtttctggaatagacttagagtgatgaatggctcttagagggacgaatggctcttagattggtaccatcacccaaccaaatactcttccttcccaacctccaagttctactccttcccttagaccgtcaccttcccctaacccacgccctcaaaatagcactaatatagctaaaatagtcaaagctaccaatcttaaacaaacaactcagagagaaacaggatacggggacacaaatgcctgtttggaatggataaaatattccacgggcacactaaacaaaagtgaatgttacacttgtgccacagggagacccgaggcccaagtggttccctttcctctgggatggtcatcagatccgcggggtcttgaacgtatgatcgtcctcttccaggacaaaacgacttggaataaagagtcctgtcggattttgtcactgctattccctgaggtcaaaagttctccaggtcagcccccgagaactgttcggctgccaaatgaaaacgtcaacttctcttcgtgtctagaatgataagaggcaaaggtgactttcttaggcaacgtgaccaggtgcagtgaaagccggtcctacaataccctccacaataaatcccagttctgagtgccccgggcagatgtctggtggtattgcaggggggtccactaatgggcatcgttccggaaaattggagtggcacctgtactttggtgcaattggccatccctttcaccgtggcatttaggccccaatcccaaactcagccaatccggaagaagcgagacatcaccccatgggggggggggtgtcctttgacccccaggtctatgttgactcagtaagtgttccatggggcattcgaaatgaatttaaggcaagaaaccaaaatgatgccactcttttggtggtcaaccatatacaaaaacattgattgggtaaactatatctattacaatcaacaaagattcattaattacactagagttgccattaaaagaacagccaaacaactggggccaactaatcaaatggcatgggaaaacagacttgctttagacatgatgctggcagaaaagggtggggtctgtgtaatgactggcatccagggctgcacctgcattcccagtaacactgccccagacagcaacaacgccaaggccctacgtggacttagcaggtgaactttcagaaaattctggtgttaatgaccccttcacagacctttcagaaaactggtttggaagctggaagggactaacagcttcaatccttacccctctaattgttgtacttagtgtccttgtcttagttggatggtgtataattccttgtgccagggacttattcaaagattaatagaaaccgtgctgacaaaactgggaccccctccccaccaaaccaatatgcttgtatggacacaacagaacatgcaagtcaaactatgctcaaagagtttgaagaaaagaatatctgatatagaaatgaaaggggaaaactgtgagaattaacatgtcttttctatcaaaggcagccatggctactccattttgttcctgcttcatctgagacacccttctccacccccctttccctcttctcccagtaacaatttgtttcaaattagccaaccgagaagaatgcgcgccctgacctgaccagtgggaaggggactgaggtaccgcctgcgttagggataaattgggggggggggggtccttccttctttgtgtgtgctttttaagcacttgcacccttctgcagaagtaaagagccttgtcgagatctccccgtgttcgtgtgtcttacttctcgacactgataatctgagccagagtca

SEQ ID NO: 97 - DNA, 2710 bp, Artificial
  ss832 sequence
cattgggaggggggtgcagggatttcctacactccccgcgccccctttcccatcgtcggtccccacagtgatgctagagctgatgttcccacattgaaacgacattatcactgaagtgggtaatttaccccagggctcgctcttgacgttgccactgttccaatccccgccccctgacacccgctcggctcttagatggaaaacattaaaaccagtacgtacgggtggaacagtggccattaaaaggggaaaaacttagctaaagaaggtggtctggggacaattggaagcaggacatatcgagcccagtaacagcccttggaattctgtcttctgtatacctaagagatcaggaaaatggagaatgtgacatgatcttagagcaattaacaccgtgactgagcctatgggacctgcccagacaggagccctttcccttctacgatcccgtcagatcgaaatgtcctaactatagacctcaaagactctttcttcactatcccactagcaaaatcagataaaggaaattttgctttgactatccctgctgtaaacttagcacagcctgaggctcgatatcgctggaaagtacagccacaaggaagttaaacagccccaccatctgtcagctttttgtacaccaggctgtaaagcccattagagattcttttccttccactcaaatctgtcattatagggatgatattctgtttgagcatcctgattctaaagaattggaccatgtaatgactgtcttacccaccatacttcatgactatggcttccatgttgcccccgagaaggtccaaaaaatatttgggacaaacaatgttggctcaaactattaaaccacagatacttcaaataaaggctgaagtaaaaactttaaatgatgcacaatgtttactaggtaccatcagttgggtgcgtccagtgctaggtattaccaataatcaaattcaacacctaactaccctcttaaagggaaatgaaaaagacctcaatgctcccagaaggttagatgagaaatcactattggaattaccacaaattaatcagaagttgcaagaatgctcatgtgacgggaggtttgcacagatgccctttcaacctttgattttgcccacagctttaatggcaccagttatgcctgctcgaatcctaaaaatggaatggttgtttttgccttcgacaaaaagctgtacgcttacgcccgtgattaccagtatttcagaacttattttaaaagggcaaaaaagacttttagagtgagacggggaagattttgaaatcatttatttacaggtacgtcagaagacgtttgaaggaaagttacaacagtctctggaaatacaaacagccttagctgactatatagggcaagtttctgatcatttgcccaaaagaccctatgttaaaactacagagtgagattgagatgattcatctgccagtcctacagaaaaccccaatcgaaaagggccaatatgtcttcattgatgcatccgaaaaaaaatgtatgtatggctacacctggtattttaacaatgaatgtcattccatcagagggcaggatgtgggctctacacagcacttggaatggccattattaaggctttacaaatgtttcctgagccacttagcggttctcagtatacagcaaaccttactcaccaaattcctacagcaatactaaagcaatactaaagttacctagtgatgagagatttgccttccttctttctactgtttatgctttagttaatacccagacccagcctctgtatttgactcagattcactcacatacctccctgctgggatggttttatgaaggaaacgaaaggactgaggccccccgtctcttgtttccttgcaagggaagctggacagtcaccttcctttttccatgaaaactggagatctcttcaacaaggtttactatttcatcacaactagctaaacacgttgtccgggcatgtcctgactgtcagtttcaggctcctgtttctcacagccctggcaccaatcctaggggattacaacctaatgccctctggcaaacagatacaactcatgttccagagtttggtaacaagtgattcttacatgtctccattgatgcctattctaaggttatctttgcttctgtacattctaaagaaacctccaaagctgctatacaacatttactgggcgcctttgcaacctggggtgagcctcaagaaataaaaacggataatggtccggcttataccagtcatacattaaaaaaatctgccacacttagggaactcagcataaaaccggactcccatacaatcctactggtcaagctgttattaaacatgcccatctcatactcaaaaccctcattaaaaaacaaaaatggggagttcccgtcttggcgcagtggttaacgaatccgactaggaaccatgaggttgcgagttcagtccctgcccttgctcagtgggttaatgatccagcgttgccgtgagctgtggtgtaggcagatgtgactcggatcccgcattgctgtggctctggcataggctggcagctacagctccaattcaacccctagcctgggaacctccatatgccacgggagcggcccaaagaaatagcaaaaagacaaaaaaggggggggagtcagatatggtgggctattccacccccagaagtacaagtcaatatagctctctat

SEQ ID NO: 98 - DNA, 4369 bp, Artificial
  ss833 sequence
tcaaaccagggagcagccacccctgcactacaaatgcctttgcaggaaacacggggaccacagcagagtgcccccgatgggaccatacaggagcggggaccagtctgttactaccagcccttttctacgactgatctcctcaactggaaacatcatacccgctcatactctgaaaagctccagacactaatcgaccttataaagtccattttccggacacatcgccccacctgggtgggctgcccgcagctccttcttactctgtttaacactgaggagcactgacaaattgctacagaagcccagaaatggctccaaacctatgccccaggggatcaattagatgtaaaaaaactgagtaaggaaagtcttcccagaggaagagccccgctaggaccccaatatcgaagggggaagaaataatttagagaggtatggacaggccctcctacagggggtaaaagctggggctaaaaagcctaacatagccaagactgctgagatgctgcaaaagccaatgaaaacccggccaacttccatgaaagactatggcaggcttttcgagtcttcaccgcttttgatcctaagccccctgagaatcaacggatcataaatgctgcctttgtaggacaagcccaatcagacatccataaaaaattacagaaattagaaggatttgcaggaaaaaatgccacaaagttactagcgatgggcaacaaggttctgccacgatatggaaaagagaatgaaacaaaaagctgcccttctggcatcagcctgtcaaaaccggtacccccagaggggccccccataaaccatggggcccaaggccaggaaaaaggggcccccatgggcacaatcagcgtgcctactgcaaagagaaggggcactggaaaattgaatgcctcaacccaactgtcctgagaggaagaccaaggcggcacccctgcctagccggtgccaaccagagccatctagcacgaattggattggcttagccgatgcggagtcagactagtggggacggggctctctccaacggggcccctagagaccatggtcagaattcaagtaggggaccgacccgtagactttatggcagacacaggtgctcgacatccagtggtcacacaacccatggctccctctcggggagagagactcccatcatcagggccacaggcaaccaaacccgcagacccttctgtggtacccgaaggtgttaggaggccatgaagtagtacatgaatttctttacctgcccgactgcccagttccttgatgggaagagacctgctggccgagatggggattcaaatctcctttaccacagatggaccagctcgcctcacattgacagacacccccgcccccttaatcatgtctcttgctgtgaggagcaaggaggaatggcgctattccctcggactagaggctgggtacccactggtttgggccgaggggaaccctcctgggcttgcaagacgccactcctatcggaatggatctgaagcctgaagcccaaccagtaaaactgcaacaatacctgattcccagagaagctcgactgggcatccaggctcacctggacagggaacttcagcgtggacttttaataaggtgccagttgccctggaacaccccctcactacatgcaaggaagccgggaacacaagaccattgcccggttcaggacttgagggccataaaggagacatcaattgcattgccctggtctgtgcccaacctgtatgccttgctggggtgaatcccttcccctgctgagtggttcacctgcctggactcacttgccttcttctgcctccgagtggcgcctgctagtcagcctttgcctttgaatgggagactccacacatagggacaaaggagcagctcacctgtacgagattcccacaaggatttgagaactcgcccactcttttcagcggcgccctggccgctgacctggctgcatttcctggaaaactagactgtgtcttgctgtggtgcattgatgacctcttgctggccagcaccacgcaggctcagtgcctagagggagcaaaagctctcctctccctgctaatggaagcagcgtaccaagtatcaaagaaaaaggcacaaatctgcaagaaacaagttaaggatctaggcttgaacatcacgtggggccaatgaatgttggaaactgagagaaaacacgcattttgtgccatcccggcccctaccacccactggagggtttgtgagttcctaggggcagcgggattctgcaggatatggacccctgagttttcagatttagccagacctctgtatgaggccctaaaaggggaagaaaaggctccccttgaatggggaccaagccaggaggcagcatttcaggcaatcaaatccaaactcactgaggctccagccttagggcttcctgatgtaaccgagagaattcaacctctttgttcatgagaagaatgggatggccttgggagtccttacccaagagttcaggccttgacagtgactggtggtgtatctgtccaaatacattgactcagtgacagccggatggcctccctgcctccaagcactggcagctaccaccttgttagtaagagaggctgataagttgatactgggacaaaacctcagcgttaaagtcctgcattcagttgtaaccctgataagcaatgggggccactattggcttccacgtgcacgaatgactcagaatcaagggttactgtgtgagacgccgtgggtaaggctggaagttgtacaaactctgaacccagccacctttctaccagatgaagcagggccccccgaccataactgcttagaggtcctggatgaggtgttttccagctggcctgacttaactgattaaaccactctgaaatcgggacccggttttatatacagatggaagtagcttcatggaggatggaaaagggatggcaggatatgctgtggtgtctgactcagaagggctggaagcggatgcacgtcttcaaggctggtcagcgcagagagcagaattatgggcagtaatcagagcgctggagctcagccgagaccagtgagttaatatctgtaccgactcacggtatgcttttgtgactttacacgtccacggagccttaggtaaggagagaggacgccttactgctgaagaaaaaggaatgaaaaaccaggctgaaatcctaaagctcctaggagcagtaatgggaacctagggaagtggcagttatccactgcaaaggccaccaaaagggaagcagtccagtggcgaaagggaagatagcgctgatgcagcctgcagacgagcagcccgggggcagcgtcagatacaccgaatgttctgctggcccgagatgtgccgatgtcgccaagtactctccagacgaagaaaaatggatgaaagaggaaggaggaaccaaaactaagatgggacccaccgtcaagtctatgttccggaacagctggcctacaagctagtcccccagcaacacgaatgtgggcaaaactgccgctactaccttatcacatgtcttcctgctcgctgctcctctctctcccaatggtgcataacttgtctgcaaaataatgctcaccaggggcatagcagaccagctgggacacaacactgtggactgtccccatctgaggatatggaagtggacttcgctgaagtcactccgagcaggggatacaaatacttgctagtttttgtctgcaccttttcaggatgggtagaagcctttcccacccaaaccgaaaaggcaagggaagtgaccaagacactcctgagagacgtcattcccagatacagaatgcctctgatccttgggtcagacaatgaacagaccagcatctgtggctgaggcagtgcagcaggtggcgaaagccttacgggtccggtggaggctacattctgcctatcaccctcagagctcagggaaagtaggacacatgaaccgaactcctaagcggactcttgcaaagttagatcaggaaaccagcctgccctgggcagacatgctgctggtggcccttctcaaagtgagatgctcaccccgagtgggaatagaattcttgccatttggatcttatatgggaggccacctccattgaacagtttgagaggaaacatcagagaattgggaggcttagattttcataaacaactacaagggttggagctcattatctcgaaaatacacaaatgagtcacagaatgcctgtatctttaggcataacagtgcatgcccacaagccaggggaccagatgtagataaaggactggaaaaaggagtctttaaagccagtatggaaagggccttatactgcaatcttaaccacccccact

SEQ ID NO: 99 - DNA, 5188 bp, Artificial
  ss834 sequence
gataacattaggcaatcccatggggaaacatatactgactttatagctagattaacagacaatcttcaaaaaactgtacccaatagctgagggagctattgatgaaaatgttagcttttgacaatgctaactcagaatgtcagaaggtattacagccccttaaagcagaaggaaaacctttagaagaatatattaaatgatattggctcagaactgtataaaatgcaattgcttgcactagctatagcaggaatacaaagtaaaaataattccaatactaaatgttttagttgtggaaagaagggacatttacaaaaaaaaaattataaccattctcctcgtccaattaatattcactttcagtgaaactgttataaagaagtattaaggataattctcgatgtcctggattacgttcccatgtccaaaaaggtaatcattgggctaatcaatgtcattctaaatttcatcaggatggttcccaacggttggggaaccggaaggagggccctgctcagggaccccaaaacaatatgagccgaaatccaacttggaatgctgttcctttcatgtaccctcagagcagcctgaactgcagtcaaacaccaaccaatcccctcttctcaccatatccggcttattgcctacaacaacaggtagcgcggccccagatattcctgctactgataatatacttctaatgccttctgtgggcgtttataagatgcccaccggaataaaggaacccatggccccgggttgtgttggattactcccgggatgaagtagtctaactagccacagagttcaggtactattgggagtaatagatgaagagtatcagggtgaaattttattaatgctaaaaacagatatacctgatcacattaataaaggagagcgtattgctcaattattactcttaccttacattcagactcaacaatctcctgttcaaagaccaggaggttttgggagtacagaaaaacaagttttttggcaaactctcgtgtctgatcaaagaccagtcctttctcttactataaatggacgaaaatttgaaagcctagtagatactggtgctgatgtttcaattatatccacttaacattggccatctaactggaataccgagtacccattatgttaactcaagtagggaccatgcaaaacataaaaaggggatcccaaattacgcaatgtataggacctgaaggacaacagcgaccttacagcctttgattgtgacattccaatacctttgtggggaagagattggctaatgcaatggggagcttatgtgactatcccaactctatctcaaaaagccaaaaatattatggccaacatgggttatgatcctttacaaaagagattggttttttcataagggccactgttaagattacagcattgctgcttaaatgggaaactgatgagcctatttggaccgaacagtggcccctctctaaagttaagttggtggctcttcaggaattagtcaaaaaacaatatgaacttggacatattttttttttttttttgccatttcttgggctgcttccgcagcagatggagttttccaggttagggatcgaattggagctgtagcctctggcctacgccagaaccacagcaacgcaggatccgggccgcatctgcaaccgacaccacagctcatggcaacgcaggatccttaacccactgagcaaggccagggatcgaacctgcaacctcatggttcttagttggattcattaaccactgcgccacaacgggaactcccggtttttgttattaaaaagaaaaatggtaaatggcagatgctgacggaccttagaaaaataaatgctattatggaacctatgggtgtataacaacctggattgccatcacctgctatgattcctgaatcatggcctattattattatgtatttaaaagactgtttctatactattccattacctcctgatgatattacacgatttgcctttacaattccttctattaataataaaggacctgtcaagagatatgtttggaaagttttgccctaaggaatgatggatagtcctacatcgtgtcaaaactttgttgcaagacctttacacagtattcgaaaacaatttcctgaggcttctattgttcattatgtggacgatattttattggcgcaccctgacaaagaaatactgcataaaatttttttgaagacagatgaggaattaatatcatatgggcttaagctagcaccagaataacttcactatgatgttccttatacttattggggttatttaatggaaaggagaatttataaacccacacaaatttcagatacgaatagagcacttaaaaacctgaaatgattttcaggaatcattaggagatggcaactggttgcgtccttcacctggtgtacctaactatcaattgacgtatttctttcaaactttaaatggggatcctgatttaaacagccctagagaattaactgaaccagctacggaacaactacaacttgctaatgaggccttacagaaaagacacattgttcgaattcgtccagaaaaaccagtttctttaattacattaccaacgaaaagttctcctactgccgtcttgtggcaaagataagggtccattagaatggcaatatctaacccatacgcctgagaaaaccatgaccacttatcttatgcttgtttctcaaataacatcgaaaggcagaactcgttgtaaacaactttcgggatgtgacccttcagaaagtatagttcctttgcacaacagccaaatgcaaccactttttgtagaaagcacggactggcaggttgccttagctgagtatgttggtgaagcacatccacattatcttaaaaatctaataatacaattttttagtaaacacgaatggataacacctgttaatacaaagcaaagccctattgctaatgccccaatttactttactgatgccaataaagagttcaaggcaggacacacaggatctactatgaagataggggtctcatcatatcagtctgtacagcaggcggagctggacgctattattaatgttctgcaggatgtgaattcacccctgaacattatttctgattcatatgtgctgttaaagtaacaaggaatattgagaccatgacattacctgaaaacactcctaaacccatttttgttttgtttaacatattacaacaaattgttcaacgtagcaattttccttttgatagttcacatgtacggtcccattccctgttgccaggacctattgcacaaggaaatgcacagattgatcaattaattatgtactcttctccgtatgaatatcacccactaactcatatcaatactaagggactggtgcgaaaatttgatatttctcgccagcaagctagagacgctgttgctgcctgtcctgaatggactcgaacacaccccgttactcatgctgacacgcttcatccacaaggaatccaatcaaatgatatttggcagacggatgttacgcacgttcccacattcgggagaatgggatgtgtacatgtatcagtagatacttactcagatgctagctttgcctcctcccacacaggataagcagttcaagatgtcaaagcacatttactgcaggccttttcctatatgggtgctccattaactataaaaacagatcatagtcctgcatatagttgtgctttaaataaattctttcaggactggaatattcaacatgtcactgggataccttgtaatcctcagggtcaagccattatagaaagagttcataaaatgctaaaaaaaatactatttttaaagaaaaaaagggggaatataggccttatgcccagggaaattctagctccagcatcattcatcttaaatttcttggatataagaggatttaatgataaaccggccatatgcatcattttgagtcccttacaaggcagcgggttagatataatccctctgccgatactgatgatgacacccctgtgttttggagaaatgaaaagcgagaatggcttgaaggatacagagtagaaaaaggacgaggttttgctcttatcgtaacagagaatggacaacttcactgggttaccagaagaaacatcaaagaaaggaaagaaaagaaattggatgagtctagatccacccggggagcctccagtacatgccctgaaatgaatgacaatttattcgtcacaggagaaaaagtcaacaccattgtcttgaaggagtaatagtaaaacaccaacatgggggcaaataataaagctcacgatatcggagttcccgttgtggcgcagtggttaacaaatctgactaggaaccacaaggttacaggttcgatccccggcctcgctcagtgggttaaggatccggtgttgccatgacctgtagtgtaggttgcagacgtggcttggatcccgtgttgctgtggctctggcataggctggtggctacagctcctattagaccccaagcctgagaacctccatatgccgcgggagcggccctagaaaaggcaaaaagacaaaaataaataaataaagctcactatagaaaggaaaaaactggtgagcattaccctttaaatgccactacgttatttgtggctataatggcagatttacagcaggtgttaattttgttgggagatcaagtgaatagttggcaaaaacaagtaagacgtaaatgtgaatggactattacttcgttttgtgtgactcctcaccagtataacaaatcgtcctttaagtgggataaagtaaaacaacatttattacatcaagggaacttgtcagttgatatcaataatttacaaaaggagatcacggaaactttctctcagaagttgcgtttacttcaaggatctaatgctctggaggccgcggctgatggtttatcacaactaaatcccgttcctcacttaaagaccattggcggtaccatgggaggctttatattcatattcatatgtcttttttgtttctatacagtctggagacgaattatgacaaaaatcaatggacaacaacagccattagccactatagcgcttgctaatatgatcaataaacaagaatcataaaaatttgaaaagggggagatattggaggcatgaatatgcaacatgacaaagaatggaaagaaaagactg

SEQ ID NO: 100 - DNA, 8735 bp, Artificial
  ss842 sequence
tgtgtgctctctgtccaagccagcagctctgctaattaggtacctagcattgcttatcagttctgcttctgtaaccttgcttgctcagtttcttagggaggaacactgtctgtttggggatgggggaggtccgggatgcttacatggaaaaatcaagaccttgtagtgtataaaagttactgagaacaaagacctggtgctcagactctggaggtgactcctctgagcccacactggtgctgaataaaccttgcttttccatatctccgagtgctgtttgtctccttccgttgccacagtttttgcggtttctgcaacattttggtgcgttggcagggaagccgacaaccgaggtggcctcttgtgccactgttgtcgaggaaccgggggaggccacggtcaccggcccagtgacaggtggatagcgcacactggccatttttgccggatccagacactcactcgggccgtgctggccttggcccataccgcttcctgaacggactcagaaggagagtggaaacaggttcctggacaggacgtcagactggtgagtgccccagggacatctgcccaagtcaggacctgccatatggtggaaggagagactgatcacctctcagtgaccaaagggtcactcaggtcagggtttgctcccttgggatcgggaggcttgtcaattctggtgtgtgtgtgtgtgagtgactggagagaacgagagcccgtgctccaccgtccttggactatggagccagagtgaatcctaaacctgcagttccatggcgacctcatacggcttatggtggccctcttcggggggatcctgacgttggggtttatacagtcccacctatgctaagaggcgcctgaaatatctcctccgggggagcggtcaggcagatgaagcaattgttacctgaggccttgtcctcactgtttgtcctgcgtcaccgtcacagggtgggactttacataatgggtaaatcggcttccaagcccactgtcttagagtgtatggttaagaattttaagaaaggattttctagagattatggtgttaagctgagtcctggaaaactgtgtaccctctgtaccctagagtggccctattttggtgttggctggcctccagaagggaccttagatgtgttcacagttacagcagtatataatgttataacaggagaccctggacacccagaccaatttccatatattgatcaatggttggaaattgcctatttgaggcccccatgggttcggttctgcaccacagaccagggacagtgtagggtgctagtagcccagtccaagaagaaaaacttgtctcaaaagaaggtgccacctatttatcaaggggaacctgatgactcgccccctatgccaccacctaatgttctgctggccccacctccaggagccaaaggtccccagatgccagatagcccaccgccttctgtttctcctcctcctctgcttctgaagttaccgaggcgatatcacccccacagccagattctccagaacctatgagcaggcatctccattcagctcagggagcagccactccagcattacaaatgcccttacgggagacacggggaccacagcaagtcgcccccgacgggaccatacaagaggggggacgtttttattattaccagcccttttccactgccgatctcctcaactggaaacaccatactccctcatattctgaaaagcctcaggcgctgattaatctcttagaattcattttccagacacactgtcccacctggatagactgccggcaactcctttttactctatttgacactgaagagcactggcgaattgtagcagaagcccaaaaatggcttcaggccaatgcggggggtcgagcagacttggcaaactgggtgagggaagccttcccagaagaaaacccccactgggactatgacactgaggaagggaaacgtaacctagagaggtaccggcaggccttcctacagggggcaaaagctggggctaaaaagcccactaatatagctaagatcagagagatactacaagagccaaatgaaagcccagccaaattctatgagagactatgtgaggctttccgaacctacaccccttttgatcccaaggcccctgagaaccaacggatgataaatgctgcctttgtgggacaagcccaatcagatatccataaaaagctacagaaattagaaggctttgcaggagagaatgccactaaactgttggaaatagcccacaaggtttttattaaccgagaccaggtggcccgctgtgatgcagaaaagagaatgaaacaaaaagtgacccttctggcagccgccctgtcaaaaccggtgcccccagtgggaccaccccgtaggggacaaggcacaaggccagggaaaatgagtcccctggaacatgaccaatgtgcttactgcaaagaaaagggacattggaaaaatgaatgccccaactgtcctgagaaaaagaccaaggccccacctagccagtactgatctgagccattcagcaccaacctgattggcctagctgagtctgattaggggggaccaggctctctccaactgggcccccgagagcctatggtcagaattcaagtagggggccaccccatagactttatggttgacacaggtgccgaactttctgtggttacacaacctgtggctcccctctcggggaaagaaaccaccattgttggggccacaggtaaccaaacccacaggcccttctgtggtcctcgacgatgtcggttaggaggccatgaagtaatacatgaatttctttacctgcctgactgcccagtccccctgatgggaagagacctgctggctaaaatgggggcacaaatttccttttctactgacggatcggcccaacttaaattgacagaacccccctctcctttaatcatggctcttgctgtaaaaagggaagaggaatggcgcttgtactctcccccttcagaaatggggaccattcccccagaactagagactaaatacccactggtttggactgaaggaaacccaccaggactggcaaaacgccacgctcctgtcttaattgatctaaaacccggagctcaaccggtaaagctacgccaatactcaattcccagagaagctcgactgggaatccaggttcacctggataggctgcttcagcatggactgttaataaaatgtcagtccccttggaacacccctttactgcccatgaaaaaaccgggaacacaggactaccgcccagtacaggacttgagagccataaatgaagcaacagtcacattacacccatccgtccctaacccatataccctgctagggctgatcccctccactgctaagtggtttacttgcctggacttaaaagatgcttttttctgcctccgggtggcacctgccagtcagcccttgtttgcttttgaatgggagaatccacatacagggacaaaggaacagatcacctggactagactcctacaaggattcaaaaactctcccactctttttagcggcgctttagctgctgacctggctgaatttcctggacaaaaactgggctgtgttttgctacagtatgttgacgacctcttactagctggcaccatggaggctcagtgcctagagggaacaagagctctcctttccctactgatggaggcagggtatcgggtatcaaagaaaaaggcacaaatctgcaaaaaacaagtatctgggcttcaacatcatgcagggccgacgaatgctggggactgaaagaaagaaggcagtttgtgccattcctgtccctaccacccgccgaaaggttcatgagttcctaggggcagcaggattctgccagatatggatccccgggttttcagacctggccaggcctctgtatgaggctctaaaaggggaagaaaaggcttcccttaaatggggaccaagccaggagacggcgtttcagccaatcaaaactaaactcactgaggctccagccttgggacttcctgatataaccagagaatttaacctttttgttcatgagaaaaatgggatggctttggcagtcttaactcaagaatttggaccttggcagaggccagtggcatatctgtctaaacaaattgactcagttactgccggatggcctccctgcctccgagcgctggcagctaccaccttgttggtaagagaggctgacaagttgaccctgggacaaaacctcaatgttaaagtcgcacactcagttgtaaccctaatggataccaggggccaccattggctcacacatgcacgaatgactcaatatcaagggttactatgtgtaaatccacggataaaactggaggttgtacgaactctgaacccagccacttttctgccagatgaagcggggcccccagaccataactgcctggaggtactagatgagatattttccagcaggcctgacttgactgataaaccactccaaaatcctgacctggttttatatactgatggcagcagctttatggaggatggaaaaaggatggcaggatatgctatggtatctgacttaaaagtgatagaagcagaggtgcttcctcaaggctggtcagcacagagagcagaattatgggccttaatcagagcactggaactcagccaagaccagcaagttaatatctataccgattcacgatatgcctttgcaactttacatgtccatggagccttatataaagaaagagggctcctaactgctgaaggaaaaggaattataaaccaggctgaaatcttaaagctcttagaggcagtatgggaacctaaagaagttgcagttatccactgtaaaggccaccaaaagggggaatgacccagtggcaaaaggaaaccgtagtgctgatgcagctgccagacaggcagcccgaggacaacagccagacaaacctaaggtcttgctggccccagaagtgccaactgtccccaaatattctccagaggaagaaaaataggtaagggaggaaggaggaactaaaactaaaacggggtggtgggtcacacgggaccaccgagtttacattccagaacagctggcctacaaactagtccgccaagaacatgagttaacccatatgggcaaaactgccttagagaccctactgggccagtactatctcattgctcgtcttcctgcactctgcccctctgtctcccaaagatgcataacctgtttacagaataatgcccgccaggggccccacagaccagctggggtgcagcactgcggactgtccccatttgaggatatggaagtggactttactgaggtcacccctagtaaggggtacaaatatttactagtttttatctgtacattttcagggtgggtagaggccttccctacccgaactgaaaaggcaagggaagtaaccaaggcactcctgagagacattattctcagatatggaatgcctctgaccatcgggtcagataatggaccggcatttgtggccgaaatagtacaacaggtggcaaaagctttacagatccgatggaaactacattctgcgtgtggccctcaaagttcagggaaagtagaacacatgaactgaacccttaaacagaccctggcaaaaatatgtcaggaaactggcttgccctggatagacatgttgccggtggccctcttaaaagtgagatgctcaccctgagcgggaataggattctcaccatttgaaatcttatatggaacgccacctccactaatcagtttaaaaggaaacaccagggagttgggagacttggaattacataaacaattacaaggacaggggctcactatttctcagatacatagatgggtcacagacagaatacctgtgtccttaggtataacagtacacccccacaagccgggggaccaggtgtggataaaggactggaaaaaggagtctttgaggccggtatggaagggcccctatactgtaattctaaccactcccactgctcttaaagtaacaggaatagatgcttggatccatcattcaagagtaaaaccggctggcacagctgacgaccttggagagtgggagactgcccttgatccggagagacctcttcgcctgacaatagagaaggagacgacgatctcaaagccctgctctgaccacaccggctgaagcttgaggaatcaacagcctggtaaaataaactgccttacctcccttccacaagagactctctaactgtcatatactgttatcttatgatcaacatgtatgtttgctgcctgttgctgttaatctggtcccctttggttctgtcaggatccatgtcctcatgtgacccgtgcattcgagtgaccccatcagatcaaggggttacatggactttgctttactccactcatttctcctgttcaggagaaattcatggaagttgtactcacaacaggaccatttattctatctgtcaacagggggaccaatatacttgctttgatccacgatactcaccaactgaggaatggttagaagtccggcactctcataaatcagggcagctaattaattggacccaaattaccaaccccaagttgccagtgtcaatacttttcgatgcctgtgaagctatgaatgggtcatggacttctactagaccatgtggaagcccatcatgggaaagagaatataggctccagcataaatatatgtgctgggggaccacctggaatgattgcctggaatgcacttactggagctgtgtggcctgggcaacctggaataagggagacaaaacagctgtccttcaaaagggtacagcccctccagactgccagactaaaacttataacccagttaatttcactattttcaattccagtgagcccaaatggaaggagggtttcaaaataagcattcacattgaccctggagctgtgttacatttccagagaatcatgtttgtgctccaagctgcttctcacagccacagcgtctttcattccttttatgaagagataagaaacaccccacctcccattccggccacaactaagaacttgttcttagccctggcagaaactattgcacaaactctcaaggtctcctcttgttatgtatgcgggggaacaaacacaggagaccactggccttggcaagccagagaactggacccattagagcctcataatgagactgcatacccccaactcaccaatggtgtatggctcctcagaactgctattatagggagaaattgtcttgcgaggcggggaggacggtttaatgtttcggtaggaagcttgacatgtttaggcctgaggtattataatctgactgcccaaaagactcaatggtggtcatcctccaatcgctcagagcccaagcctaatcccttgtctaacttttcccatcttcgacaagcctgggaagatatcagtactaacatccagtggtgggcaccaaagggattatattggacttgtggaaaaatggcctattctatactccccccaaattgggctggggcatgtgtactgggaacaatcagaccttccttcttcctgctccctctgtcactaggagagcaactgggagttcctatatatagggcacagggtgcccagagaccggagggctctccaaattggagagtggaaagatgatgaatggcccccagaacggataattcaatattatggacctgccgcctgggcagaggatggctcttggggatatcgcacccctatctatatgctcaaccgcatcatcagactacaggcggttttggaacttataacaaatgacactgcaagggccttgactatattggcccaacaacaaactaaaatgcgcagtgcaatctaccaaaatcgtttggccttggattatttacttgcttctgaaggaggggtttgtggaaaatttaaattaagtaattgctgtgtataaatagatgacaccggaaaggtagtagaagaaattgctgaccgcatgactaaactagcccatgtacctgtacaaacttggaaaggatgggatgcagacagtctctttggtaaatggttctcttggttgggaggaattaagacaatggtcggaatagtcatggttatacttacagggtgcctacttgttccctgccttatacctctcctgataaatattataaaaggttttataaaaaccatggttgaaagaaaaacagcctcccacctgctacttattagaggctaccaaagggttatgactgatgatgatttgtaaagggtgcagatgcaccctgaacatcaagaggggggaatgaaatggaattttaactaaagaacaacccccccttggctaagaaggcagctgcaagcctttccagctgcgctaatcactatgccacccttcttgtaataatgtaacaactgtgtgctctctgtccaagccagcagccctgctaattaggtacctagcattgcttatcagttctgcttctgtaaccttgcttgctcagtttcttagggaggaacactgtctgcttggggatgggggaggtccgggatgcttacacggaaaaatcaagaccttgtagtgtataaaagttactgagaacaaagacctggtgctcagactctggaggtgactcctctgaacccacaccggtgctgaataaaccttgcttttccatatctccgagtgctgtttgtctccttccgttgccacagtttttgcagtttctgca

SEQ ID NO: 101 - DNA, 5688 bp, Artificial
  ss845 sequence
tggtgcgttggcagggaagccgacaaccgaggtggcctcttgtgccactgttgtcgaggaaccgggggaggccacggtcaccggcccagtgacaggtggatagcgcacactggccatttttgccggatccagacactcactcgggccgtgctggccttggcccataccgcttcctgaacggactcagaaggagagtggaaacaggttcctggacaggacgtcagactggtgagtgccccagggacatctgcccaagtcaggacctgccatatggtggaaggagagactgatcacctctcagtgaccaaagggtcactcaggtcagggtttgctcccttgggatcgggaggcttgtcaattctggtgtgtgtgtgtgtgagtgactggagagaacgagagcccgtgctccaccgtccttggactatggagccagagtgaatcctaaacctgcagttccatggcgacctcatacggcttatggtggccctcttcggggggatcctgacgttggggtttatacagtcccacctatgctaagaggcgcctgaaatatctcctccgggggagcggtcaggcagatgaagcaattgttacctgaggccttgtcctcactgtttgtcctgcgtcaccgtcacagggtgggactttacataatgggtaaatcggcttccaagcccactgtcttagagtgtatggttaagaattttaagaaaggattttctagagattatggtgttaagctgagtcctggaaaactgtgtaccctctgtaccctagagtggccctattttggtgttggctggcctccagaagggaccttagatgtgttcacagttacagcagtatataatgttataacaggagaccctggacacccagaccaatttccatatattgatcaatggttggaaattgcctatttgaggcccccatgggttcggttctgcaccacagaccagggacagtgtagggtgctagtagcccagtccaagaagaaaaacttgtctcaaaagaaggtgccacctatttatcaaggggaacctgatgactcgccccctatgccaccacctaatgttctgctggccccacctccaggagccaaaggtccccagatgccagatagcccaccgccttctgtttctcctcctcctctgcttctgaagttaccgaggcgatatcacccccacagccagattctccagaacctatgagcaggcatctccattcagctcagggagcagccactccagcattacaaatgcccttacgggagacacggggaccacagcaagtcgcccccgacgggaccatacaagaggggggacgtttttattattaccagcccttttccactgccgatctcctcaactggaaacaccatactccctcatattctgaaaagcctcaggcgctgattgatctcttagaattcattttccagacacactgtcccacctggatagactgccggcaactcctttttactctatttgacactgaagagcactggcgaattgtagcagaagcccaaaaatggcttcaggccaatgcggggggtcgagcagacttggcaaactgggtgagggaagccttcccagaagaaaacccccactgggactatgacactgaggaagggaaacgtaacctagagaggtaccggcaggccttcctacagggggcaaaagctggggctaaaaagcccactaatatagctaagatcagagagatactacaagagccaaatgaaagcccagccaaattctatgagagactatgtgaggctttccgaacctacaccccttttgatcccaaggcccctgagaaccaacggatgataaatgctgcctttgtgggacaagcccaatcagatatccataaaaagctacagaaattagaaggctttgcaggagagaatgccactaaactgttggaaatagcccacaaggtttttattaaccgagaccaggtggcccgctgtgatgcagaaaagagaatgaaacaaaaagtgacccttctggcagccgccctgtcaaaaccggtgcccccagtgggaccaccccgtaggggacaaggcacaaggccagggaaaatgagtcccctggaacatgaccaatgtgcttactgcaaagaaaagggacattggaaaaatgaatgccccaactgtcctgagaaaaagaccaaggccccacctagccagtactgatctgagccattcagcaccaacctgattggcctagctgagtctgattaggggggaccaggctctctccaactgggcccccgagagcctatggtcagaattcaagtagggggccaccccatagactttatggttgacacaggtgccgaactttctgtggttacacaacctgtggctcccctctcggggaaagaaaccaccattgttggggccacaggtaaccaaacccacaggcccttctgtggtcctcgacgatgtcggttaggaggccatgaagtaatacatgaatttctttacctgcctgactgcccagtccccctgatgggaagagacctgctggctaaaatgggggcacaaatttccttttctactgacggatcggcccaacttaaattgacagaacccccctctcctttaatcatggctcttgctgtaaaaagggaagaggaatggcgcttgtactctcccccttcagaaatggggaccatttccccagaactagagactaaatacccactggtttggactgaaggaaacccaccaggactggcaaaacgccacgctcctgtcttaattgatctaaaacccggagctcaaccggtaaagctacgccaatactcaattcccagagaagctcgactgggaatccaggttcacctggataggctgcttcagcatggactgttaataaaatgtcagtccccttggaacacccctttactgcccatgaaaaaaccgggaacacaggactaccgcccagtacaggacttgagagccataaatgaagcaacagtcacattacacccatccgtccctaacccatataccctgctagggctgatcccctccactgctaagtggtttacttgcctggacttaaaagatgcttttttctgcctccgggtggcacctgccagtcagcccttgtttgcttttgaatgggagaatccacatacagggacaaaggaacagatcacctggactagactcctacaaggattcaaaaactctcccactctttttagcggcgctttagctgctgacctggctgaatttcctggacaaaaactgggctgtgttttgctacagtatgttgacgacctcttactagctggcaccatggaggctcagtgcctagagggaacaagagctctcctttccctactgatggaggcagggtatcgggtatcaaagaaaaaggcacaaatctgcaaaaaacaagtatctgggcttcaacatcatgcagggccgacgaatgctggggactgaaagaaagaaggcagtttgtgccattcctgtccctaccacccgccgaaaggttcatgagttcctaggggcagcaggattctgccagatatggatccccgggttttcagacctggccaggcctctgtatgaggctctaaaaggggaagaaaaggcttcccttaaatggggaccaagccaggagacggcgtttcagccaatcaaaactaaactcactgaggctccagccttgggacttcctgatataaccagagaatttaacctttttgttcatgagaaaaatgggatggctttggcagtcttaactcaagaatttggaccttggcagaggccagtggcatatctgtctaaacaaattgactcagttactgccggatggcctccctgcctccgagcgctggcagctaccaccttgttggtaagagaggctgacaagttgaccctgggacaaaacctcaatgttaaagtcgcacactcagttgtaaccctaatggataccaggggccaccattggctcacacatgcacgaatgactcaatatcaagggttactatgtgtaaatccacggataaaactggaggttgtacgaactctgaacccagccacttttctgccagatgaagcggggcccccagaccataactgcctggaggtactagatgagatattttccagcaggcctgacttgactgataaaccactccaaaatcctgacctggttttatatactgatggcagcagctttatggaggatggaaaaaggatggcaggatatgctatggtatctgacttaaaagtgatagaagcagaggtgcttcctcaaggctggtcagcacagagagcagaattatgggccttaatcagagcactggaactcagccaagaccagcaagttaatatctataccgattcacgatatgcctttgcaactttacatgtccatggagccttatataaagaaagagggctcctaactgctgaaggaaaaggaattataaaccaggctgaaatcttaaagctcttagaggcagtatgggaacctaaagaagttgcagttatccactgtaaaggccaccaaaagggggaatgacccagtggcaaaaggaaaccgtagtgctgatgcagctgccagacaggcagcccgaggacaacagccagacaaacctaaggtcttgctggccccagaagtgccaactgtccccaaatattctccagaggaagaaaaataggtaagggaggaaggaggaactaaaactaaaacggggtggtgggtcacacgggaccaccgagtttacattccagaacagctggcctacaaactagtccgccaagaacatgagttaacccatatgggcaaaactgccttagagaccctactgggccagtactatctcattgctcgtcttcctgcactctgcccctctgtctcccaaagatgcataacctgtttacagaataatgcccgccaggggccccacagaccagctggggtgcagcactgcggactgtccccatttgaggatatggaagtggactttactgaggtcacccctagtaaggggtacaaatatttactagtttttatctgtacattttcagggtgggtagaggccttccctacccgaactgaaaaggcaagggaagtaaccaaggcactcctgagagacattattctcagatatggaatgcctctgaccatcgggtcagataatggaccggcatttgtggccgaaatagtacaacaggtggcaaaagctttacagatccgatggaaactacattctgcgtgtggccctcaaagttcagggaaagtagaacacatgaactgaacccttaaacagaccctggcaaaaatatgtcaggaaactggcttgccctggatagacatgttgccggtggccctcttaaaagtgagatgctcaccctgagcgggaataggattctcaccatttgaaatcttatatggaacgccacctccactaatcagtttaaaaggaaacaccagggagttgggagacttggaattacataaacaattacaaggacaggggctcactatttctcagatacatagatgggtcacagacagaatacctgtgtccttaggtataacagtacacccccacaagccgggggaccaggtgtggataaaggactggaaaaaggagtctttgaggccggtatggaagggcccctatactgtaattctaaccactcccact

SEQ ID NO: 102 - DNA, 8090 bp, Artificial
  ss855 sequence
atggggaattatgacagtatacctgacggcagtcccttgaaaagtgttcttcaaggttggtcactgtatagctctaagtctatgaaaaagaagaaaatgatttccttttgtaaccatgtctggcccaaatatcaattggaatctggggaaaaatggcccaagaatgggtctttgaactataatactattacacagttggactcattttgtaagagagagaaaaaatggggcgaaattccatatgtagaatcatttatgtctttatataagaggataaatttgcatatgacctttaaaatgatggttcagaaggttgaacctcagaaaaagcccgttttacccgagtcaaagcctgaaggtgttccagtactgcctctgcgggcgcctggtgcggtagcccatccctcagcaccacctcttcccatagcccctctctccgcacctcttccggtagcccctccctcagcacctcttgaagttcccgtgacttctgacggggctcttcctgcaggcggtgctaaggcttctaccagtcctcctagggtggctgattcagctctttccagatggtcgcccttaccagatggtcataaaggaatggtctcccctccctgtaccctccagggtactcaatctggcccgggggaaactctaccccaggcagggcagtttctgttaaggcaggtgccagtaggcttggacgaccaaggccaacccagagcacttggactcacaccttcttcatcagtcattaatttacataattataaagctaaaacgccatcatatcaagatgatcttaagaagatggagactctctttacatccgtttttgctgtttttcatcctaacccggctgacatacagaccctcaagcatatcttcctcagtcaggaggaacccagcacgatattagagaagtcctgcctggaagctgaaaggctccattacttacagccagatgatccaatcagaactcaggcagagctggccatccctgaaactgaaccaggatgggatcccagtgacccaggggatcaagcaaggcttaatcattataaagaatgtttaataactggacttcaaaagggggcagagaacttcaagagggtccagaatgtacaacaagggcccaaggaggacccattcaccttccatgtgaggctttttgatgctttacgaaaatatactgatatagatccagaacacccagataatctgggactggtcaaggtaatcttcatcagtcagagtgccccagacataagaaagagactacagcaactggaacggggattgtggatgccaacatctcagttgcttcagattgcttttgaggtattcaatggccgagataaaattagggaaaagcaggaggagcaaaacatcacaaggcaggttgcactgcgcagctgtaaccagtcaaggcccagcagaacatctggaggacagaacaaacgacaaagggcaaaaccccagggacctccaaaaccgggccaaaaaggccatccatttgttgagccacgacagtgtgccttttatagacagaaaggacattggaaatgggactgtcccagaaacccagcgagcctccactccctcaagagagcatccattactggtgtatatggggaagtctctcataaaccttttctaccacggctcgaatgtcacatagagaaaacatttgtcaagtataactttatgtatgtgcctgaatgttgtggtcccttgtcagggcaagaacaatcaacacatttcaatgcccaagtgcctttcgcaggagaaaacggagacaccaaagcactcccagctcaacagtgtgccctccaacctgcaccattacagttgggagacaagcctcaaccagatgtccctgaagaaattctacaaaacgtaagagcagatgtttgggcggatgggacgccaggaagagccaagatggctgagccagtagttgtaagactccgtccaggcgcccaggctccaaaggtaccacagtacccattaaagaggcatgtaaaggaaaagataaagcctctgataatcaactttcttaaacacaaattaatccgaccttgtcagtccccatataacacccctatcctgctggtacaaaaacctaggactgaagacctctttgtacaagatttgagagccatcaacaaaatcgtaaaggagataccttcagtggtgccaaattcttatactttgctgacagctttatcaggagactttggctggtttacagttctgaatgtaaaagatgccttttactgcatacccctaagtcctgagtcccaggaactgtttgcctttgaatgggatgatccacagaccaatataaaacagcaatattgctggactgtacttccacaaggatttaaaaatgctgccaccatctttatggaggtctttgccaaggacttgaaggatctccaattaaatgaaggatgcttactcccgtatgtgggtacgatactcatcgctagtaaaacgaaggaagcttctgaccaaaatacaattctcactttaaactttttggcagaccgaggatataaaatctccaagggaaagtcacaattttctcaaccaactgtaccatttctaggaattgagttatcaaaaggacaaagaaacttattgccgagtcgaagggaagcattagctgaggtagaggtacctgccaccagaaagcaattgagaagattcttagcaatggctgagttttgtcggatttggattcctaactttggactcatagtcaaacctctgtatgaggctctcaaaaggagtgtcaatgagccactgagctggactgaagaatgccttgaggcattccataccatccagaagaaaattttaaaagccccagcacttggtctcccagacatcggaaagccatttgatctttttgtgcatgaaagacagggcctgagtcttggagtgctcactcaaaatttagattctgccagaaggccggtagcttacttttccaaacaattggatgctgtaactcgaggatggccagtttgcctccaggctgtggctgcaacctgtgaccttttacagcaagctgaaaaatttaccctggactgtcccatcactgtgcacaccccacatcgtgtgcaacctttacttggacaaaggggcagctactggcttactaccaagaggctgaaaagatacaaggtcatactctttgacaaccgaaatgtaacattaaaggaggtatctgctttaaacccagacactctgctccccagtacaacagaagaacctgttcatgactgtatccaaaaaattaaagaagattattctagcagacctgacctgactgatcagccgttagagaatccggatatggaaatgtttacacatgggagcagcttcatggaccatggactccgaaaagctgggtatgccgtgataactcatcaggaaatcctagaagcagaagccctccctccaggtacatctgcccagaaggcagagctggtagccatcaggagagctctgcatcttggagctaagaaaaaggtaaccatttatactgattctgagtacatcttctctgtcatgcacgtatatggggccatgtggaagaagaaaggccagctaacatcaggaagaaaaaaaattgaacacacagaggagatattggccttattaaaatctgttttcatgccggaagaagtagccatagtactttgcccatgccaagagactgacggttatatagctagaggcaataatttggctgaacaggctgccaaacaggcagccagaatcaaacacccttagtgctcattccaggtatggacctatccctgtttaaggcttgtgttattcagaaatggatctggaaagagcagacaaatggggatttcatgctgactgttgagacctggatgatgagcagtaccaaatatccaaagaaggctggatatgtaatgaatagggactagtgctcacaccccagcatttaatggaaaaaattattatttctctacgtcaaggaatccatgatggaaaggatgcaacctatcactggctccaaagttgattattgtcagtccataaatgcaaagaaccatccagaagtaatacaaaatggcctcatttacatcagaaacactcctaaaactgggccacctccaataataaaaggggtgtgaacttgagggacagaacccgaagatgactggcaaaaagactcatatcaagagctgtgggacattctagatatctgctggtattggaggacaccttcacagaatggctcaaagcttttccacactggagagagaaagcttcctcggtaaaaaggtctcactagggagttcctgttgtggcacagcagattgggaacccagctagtatccatgaggatgagggttcaatccgtggccttgttcagtgggttaaaggatccagcgttgctgagagctgtggtgcagatcacagacaaggcacagatcccaagctgctgcggctgtggtgtaggccagcagctgcagctccaattctacccctagcctgggaacttccatctgctgcacctgcaggcccccgctccaaaaaaaaaggccttactaaaagaaattatccctccttttgagttccctctttcaattcaaagtgatggtagaggagctttcgtagccaagatcactcaagggggatctgaagctcttagaatagagcagaagttaaatgcttcatagagctctcgtgaccgaaatgatgaatcctatcttttaagagacaactgccaatgtcaagaagccaactttacttgagatgaggtcttaacagttgccctgccaagggtaagagtagcccctcgaagcgagcttcatttgagcccttaatgttatacaggagaccattccttaagactattatttcagtcttgaaaatgatcccattccaaaagaattagatactataaaatgtatagtttcttggtgttctcttattttctgctaatattatgcttctagatgattcatttttcccacagacatccctgtgcactgtctaaacccaaggaatcgcatcctcctcaaatgtggaaaatcactaccccgaggatcaactgcaacccaagtggaatatgggccctttgaggtccctctggttacacattcttcagcctcgctcaaaggagttaaaccttggatacatcactcccgagtaaaaattgtacccatttccaaccagcacccaccttgtgccctttacggttcccaaatggggcatactctccatggacaggagggaggaggaggacccagcaccagaggggcctagaaacccactatggacttcttggcctctaattataaattacttttcaaatagaaataggacaggagttcctgctgtggctcaaggggatcagctgcgtctctggtgcgcccagatgcaggtttgattccccagcccagaatagtgggttaaggatccagcgttgccccagctgtggtgtaggtcacaactgcatcttggatctgatccctggcctgggaactccatatgccgcggggcaaccaaaagagaaaagaaaagaaacgggacagctaagactctacctggccaggaagagaagaggacatttcaaaagtagacagcttctgcccagaagtctcaaccaggcctacatacatccgaatcaaattactaaaaatgttaaaaatagtgtgttttcatggattcccaaaggaataaggtctgtttttggagaaatgttaaaattaggactcagttttgtgtatattgggattaacccctttactcaccaaattttttacttatcgtctgtcccgtatatttaaaaaggcctcccagactcacatgatgattgcccaagacttaagagttcaaggtgggactcaggaatatttacaatccagtgcaaaaacaatttcattcctctatgtccctaatctacgcccctaatcagcaggaagcagctagagcggtcgtcgccctatttcccttaagatcgaggaatgtacaaagaaaaggggggaatagaaactgcacataaaatgttgatctgctttcaatggttttgcttccttaaataggctgttgtttaatcaaaccttgagttattttatagagacagcatggcgcgtgtacaagatggaagccctggaggaccctggaaccaagaatcttcaagtctttggaactcagacaatagaaatgttgctgctggagcccttcaccaagcaagaagttcttcagtaagaaaaacctgggaattccctggtggctcagcaggttaaggatccagcattatcactgctgtggtgtggtttccatttcggcccaggaactgctgcctgccacaggcgtggccaaggaaaagaaaaatctggcttctagctgcccaagtagcttgattccaatcagcttctgacttttaagactagccaatcagtttctgctaagtttgaagctcccctcaccctttaccttttgccctgaacactggatagggagacagatttgagccctgcctcctgttttattgacttcccaataaaacttgcttttttcaaaaactggtgccatagcattggcttctatgtgtgtcagacagagagcgcttcttggtaacaaaaggctgagaaatatctgctgatgcataaaacattatttctatctgatagagtggaaatggttacagtatttgctgctcataaagcagcattccaagaatctactaagactacatcttctattaacattagttgataaaggagttcccattgtggctcagtacattaagaacccgacatagggtttgtgaggatgtgggttcaaaccctggcctcgttcagtgggttaaaggatccagtattactgcaagctgcagtgtaggctgcaaatttggtttggatctggcattgctcttgctgtggctatggctggcggctgcagctctgatttgacccctagcccaggaatgtccatatgccacaggtgtggctgtaaaaagaaaaagaaaagaaaaaattaacattggttgataaaattgcacctgagctggaggaccagaactactgaagttctctaatgacagatccataccttcatattacctcagaaacttactttatgtgtcttcctaaacaatgttgttttgtcttcctaaataatcgtggctcagtggttaacgaatccgactaggatccatgaggttgcaggttcggtccctgcccttgctcagtgggttaacgatctggcgttgccgtgaggctgtggtgtaggttgcagacatggctcggattccgcgttgctgtggctctggcataggccggtggctacagctccaattggacccctagcctgggaacctccatgtgccgtgggatcagcccaagaaatagcaaaaagacaaaaaaaaaaaaaaaaacaatgttgttttactttcctacagtacagaattggagaccctggattttaaagtgcaactctggacacctccaactttaacatgctgtgtgatcttagagaagttacttaggatttctgtgcctcaggtttgccaagtgtaaaaaagataatagctgctttaaaggtggactgcaaggactgaacaagttactatgctgaaaaacttaaaatgcttgacccacagtaaagctgttatcatcaagggggcttgcctgccttaagatttattttattattattattattattattattattattattgctttttatggccacacttgtggcatatggaagttcccaggctaggggtcaaatcggagctgcagctgcaggcctgtgccatagccacagcaacgctagatctgagccatgtctgcaaactacaccacagctttcagcaatgctggatccttaactccctgagcagggccagggattgaacctgtatcctcacagatgctagtcaggtttatttccactgagccacaatgggaactcccaccttaagaagatttataattcacatttctttttttcttctttttttttttttttttgtctttttgcctttttctagggctgtttccgcagcatatggagattcccaggctagg

SEQ ID NO: 103 - DNA, 6577 bp, Artificial
  ss775 sequence
aagaagaaaactttgcctctaggaaatgggccacatatttttcaaggagaggccaaggactcaccccttgagccacctccttatgtactaccagcccctcctttggaggccgaaggtccccagttgtgagacagcccaccaccttctgcttttcctcctcctcctgaagtccacaaggcaatatcacccccgcagctggatcaccagaactgatgagcaggcatctctggtagacccagggagccaccccagagctacaaatgcccttacaggagatgtggggaccacagcctattgcccctgatgggatcatgcaagaggggggaccagtcttttactaccagcccttttccatgacaaacctcctccactggaagcaacatataccctcttactctgaaaagcctcaggcactgattgacctcttagaatccattttccagacacactgcccctcctgggtagactatcagcaggtcatctcactttgtttaacactgaggaacaccaacgaatcttaacagaaggccagaaatgactccaggccagtgccccaggggatcaactagatgtggcaaactgggcaagggaagacttcttgggggaaggacccccactgggatcatgacaccgaagaggggaagaaataatttggagagatactggcaggccttcctacagggggtcaaagccagggctaaaaagcctaacatggtcaagaccactgaggtgctgcgaaagctggatgaaaaccgggccaacttgtatgagagattacatgaggcttttcggatcttcaccccttttggtcctgaagcccctaaaaaccagtggatgatacatgctacttttgtgggacaagcccaatcagacattcataaaaagttaccgaaattagaaggatttgcaggaaaaaaaagacactgaattactagaaatagccaacaaagttttcattaaccatgaccaaatggcccaccccgatgcagaaaagagaatgaaacaaaaagccacgctttcagtggcagccctgtcaaaactggtacccctagtgggaccaccccataagtcatggggccaaggccaggaaaaaggagccccctcggacattatcagtgtgcctactgtaaagaaaagggacactgggaaaatgaatgctccaattgtccagagagaaagaccaaagtggcacccccacctagctgataccaacccgagccatccagcgcaaatctgatcagcttagatgaagcagaatccaagtagggggaaccagtctctctctaactgggtccccgagagcctatggtcaaaattcaagtagggagccatcccagagactttatgatagatacaggtagtgaacatatggtggtcacataatccatggccaccctcttgggaaaagaaactaccatcataggggccacagatccccaaacacacaggcccttctgcagtcccccatagtgctgttaggaggccatgaggtagtacatgaatttctttacctacctgactgcccatttcccttgatgggaaggacctactggccaagatgggggtgcaaatctcctccaatgatggatcagctcaactcaatagaatctccctctcctttaatcatagctcttcccataaggtgggaagaagaatggtgtctatattcttcccctccagaagagggaaccattcccctgcaactagggactgagtacccattggtttgggctgagagaaaccctccaggaatagcaagacaccacactcctatcttgattgatctgaaacctggagctcaaccagtaaagctatggcagtacttgattcccagagaagctcgactgggaatccaggtgcacctggacaggctacttcagcatgggcttttgataaagtgccagtcaccctggaacacccccttattgcctaaagaaaccaggaactagactaccgcctggttcaggacttgagggccataaatgaagcaagagtcacattgcacctgtccgtgccaaacccgtataccctgctggggctgatcccttccactgccaagtggttcacttgcctggacttaaagatgcctttttctgcctctgagtggcacctgcttgtcagcccttatttgcctttgaatgggaaaatccacacactgggacaaaggagcagctctcttggacaagactcccatgaggattcaaaaactctcctactcttttcagcagtgccctggcctccgacctggctgaatttcctggacaaaaactagactgtgtcttgctacagtatgttgatgagctcttgctggccagcaccatgcaggcccaatgcctagaaggaacaaaagctctcctctccctactaatggaggctgggtattggatatcaaagaaaaaggcacaaatctgtaagaaacaagtcaagtatctgggttttaacatcacacggggctgacaaatgttggggactgaaagaaaagacacagtttgtgccattctggtccctaccaccaactggaagtttcgtgagttcttaggggcagcgggattctggaggatatggacccctggcttttcagacttggccagacctctatatgaggacctgaaagggaaagaaaaggctccccttgaatggggactgaacaaggaggcagcatttcagacaatcaagaccaaagtcactgaggctccagccttagggcttcctgacataatcataaaattcaacctctttgttcatgaggaaaatggaatggccttgagagtcctaacccaagaatttgggccttggcggaggccggtggcatatttgtccaagcaaattgactcagttgtggccagatggcctccctgcctctgagcactgatagctgccaccttgttagtaagggaagctgacaagttgactctgggacagaacctcaatgttaaagtcccacattcagctgtaaccctgatggacaatcggggccaccattggctcacacatgcacaaatgactcaataccaagggttactatgcaaaaatctgtaggtaaatctagaagttgtatgaactctgaacccagccatgtttctaccaaatgaagtggggcccccagaccataactgcttagaggtactagatgaagtgttttccagcagacctgacttaactgataaaccactccaaaatccagacctagttctatatactgatggcagcagcttcatggaggatggaaaaaggatggcaggatatgctgtggtatctgactcagaagtgatggaagcagaagcgcttcctccaggttggtgagcacagagagaattatgggcattaatcagagcactgaagctcagcagaatcaatatctataccaagtcatggtttgcctttgcaactctgcatgtccacagagccttatataaggagagagaactccttattgctaaaggaaaagggatcaaaaaccaggttgaaatcttaaagctcctagaagcagtgtgggagcctaaggaagtggcagttatctactgcaaaggccaccaaaagggaggtgaccccatgacaagaggaaaccgcagtgttgctgcagctgccagaaaaatccaaagtcctgctggccccagaagtgccgactgttcccaagtactctctagaagaggaaaaaatggatcaaagaggatgggggaaccaaaactaagacagggtggtaggtcacacaagatgctgggcttatgttcaaaacagctggcctaccaaccagtccaccagcaacacaaattgactcacatgggcaaaactgccttagagattttactgggtcagtcctacctcattgcacttcttccagcaccctgatcctctgtctcccaactgtgtataacttgtttgcaaaataatgctctccaggggtctagcagaccagctgggacacaacattgtggactgtccccatttaaggatatggaaatggacttcactgaaatcactccaagcagggaatacagatacctgctagtttttgtctgcaccttttcgggatgggtagaagacttcccaacccaaacagaaaaggcaagggaagtagccaaggtactcctgagagacatcattcccagatacagaatgactctgaccattgggtcagacaaccaaccggcatttgtggccgagacagtgaagccaatggcgaaaatcttacagatcctgtggaaactacattctgcctatcaccctcaaagttcagggaaagtagaaagcatgaatcagacccttaaacagacactagcaaagttatgtcaggaaactggcttgccctgggtagacatgttgccagtggccctcataaaagtgagatgctcatcctgaacgggaataggattcttgccatttgaaatcttaaatggaaggatgcctccactgttcagtttggggccaaacaccagagattgggagacttagatttacataaacaactgcaagaattggggctcaccatctcaggaatacacaagtgggtgacagatagaatacccatatccttaggtataatagtgcacccccacaaaccgggggaccacgcatggataaaggattggaaaaaggagcctttaaatccagtatggaaagggccctatactgtaatcttaaccacccccactgctctcaaagtaacaggaatagacacctggatccatcattccagagttaagccggctggccggactgatgtccttggggaatggaaggctgcccttgatccagaaaaaccaccatgtctgacaatacagaggcagagacaacaatctcaaagccctgctctgactacactggaagctggtcagtcgatgcacagctgaagcttgaggaattggctgcccggtgaaacagactgccttattttctatagaaactcccttactgtcatatactgttatcccatgcctgatatgtatgtttgttggttgctgttactaatctggtctccctttgccctgccaggatccatttcctctttcaacccatgcatttgagtaaccccatcagatcagggggttacacggactttgctttactctactcatttgaaagttgtacttacaaaaaaaccacttactctatctgtcaccatgatggccaatatatttgctttgatccacaatactcaccaactgaggaatggttagaggtctggcgctctcataaggcagggcacctgattaattggacccaaatcaccaaccctaaattgctagtatctgtagtttttgatgcctgtgaagctatggatgggtcatggacttctaccagaccatgtgggagcctgtcatgggaaagagaatataggctccaagatacatatatgtgtgattcctcaaccacaactgtctggaatggtggtcaaaatgtcatgagcttctattgctcttactggggctgtgaatcctggacgacttgggataaaggagacaaaaccactgtccttcacaaggacatggcccctccagactgtcagactaagacttgaaacccagttaatttcactatttacaattccaatgagcccaaatggaaggagggtctcattataggcatacgcattaatggaagaggcaatgaccctggagctctgctacatttccagaaggtcacacttatgctccaggctgcctctcacagggttttgcattctttttacaaggaaatgaagaacaccctgcctcccatttcagctacaactaaaaatttgtttttggccctggcagagaccattgcacaaaccctcaaaatctcctcttgctatgtaggtagaggagcaaagatgggagaccactggccttggcaggctagacaactggaccattggagccccataatgaagctgcatagctccaactcaccaatggggtatggcttctcaggactgcttttatgggaaaaactgccttgcaaggtggggaggatggttcagtgtgtcatttgggagcctaatgtgtttaggcctaaggttttataacctaactgcccaaaaggcttgatggtgggcatcttcaaatctctcaaagcccaagtctaatcctctgtctaacatttcccacctctggcaggcatgggacgatgtcagtgccgatatccaatggcaggcgccaaagggattatattggatctttggaaaagtggcatattccgtactccccccatctaggcaggagcacgtgtgctgggaactatcagaccatccttcttcctgctcctgttatcattaggagaacaactgggtgttcctatgtatagggcaccgggcacccagagagactgaagggccctccagattggagactggaaagatgatgagtggcccccagaatgagtaattcaatattatgggcccaccacttgggcagaggctggctcctgggggtaccacacccctatctttatgctgaaccatatcatcagattacaggcagtattagagcttataacaaatgacacagcaagggccctgactatattagcccaacaacaaactaaaatgtataatgccatctaccaaaactgcctagccttggattatttacttgct

SEQ ID NO: 104 - DNA, 8959 bp, Artificial
  ss774 sequence
tgtcagcagctttgctcaccacataccatcctacctgtaatctcagagcagctacgtgccttatgtccttgcttgcagccctgcgaaccatgctccaagcattgcttatcagttttgcttttgtaatcctgcttgcccagctccttaggcaggaactctgtctgttcaggaaaggggagggccggggctgcttgcatgggaaaatcttaagccctggaagtctgtattatataaaagttatccagaacaaaggcctggtgctcagactctggaggcgactcctctgagccctcaccagtgctgaataaacctggctattctatatctctgagtgttgtttgtctctttctgctgctatgatttctataacattttctggtgcgttggccaggaagccaacaatggagctagccccttgtgccaccgttgttggggaactggggaaggccatgatcaccagcctgctgacaggcagatagcacgcacctggccctttgccggatcctaactctcacttgggctgtgccagccccggctaatgccacttcccaaacagactcagaaggagagcagaaacaggttccaggacgggacgtcagactggtgagtgccctgggtcaggacccgccatacagtgcatggagagactgatcatctctcagtgcccagagggtcactcaggacaggatttgttccctcaggatcagatggtgtgtcaattctggtgtgtgtgtgagtgactggagagaacaagagcccatgctccaccgtcttcgggctacggagcttgagtgagtcctaacctgcagttccatggtgacctcataaggcttacaggctgcctcaggttctgagagttctctttcctcactgcgagactggtctgggcccagggtttatatggaccagccacacactaagagataccttaaacccctgagaggggagcgatcagaccaatgaaagtgagtgctccccctactgtttgtcttgtaacatcaccacagtgcgggaattcacacaatgggtacattggcctcaaaacccactgtcctagaatgtatggttaagaattttaagaaaggattttctggagattatggtataaaactgagttttggaaaagtgctcattctctgtaccctggagtggccctccttcagggttggatggccatcggaagggaccttagacgtgcccatggtttgagcagtatatagtaacaggagacccaggacacccagaccaatttctgtacatcaatcaatggctagaagttgcccagttaaggccctctttagttgggttctgtgtcacagaccagggacagtgtaaggtcctagtagctcagtctaagaagaaaactttgcctctaggaaatgggccacatatttttcaaggagaggccaaggactcaccccttgagccacctccttatgtactaccagcccctcctttggaggccgaaggtccccagttgtgagacagcccaccaccttctgcttttcctcctcctcctgaagtccacaaggcaatatcacccccgcagctggatcaccagaactgatgagcaggcatctctggtagacccagggagccaccccagagctacaaatgcccttacaggagatgtggggaccacagcctattgcccctgatgggatcatgcaagaggggggaccagtcttttactaccagcccttttccatgacaaacctcctccactggaagcaacatataccctcttactctgaaaagcctcaggcactgattgacctcttagaatccattttccagacacactgcccctcctgggtagactatcagcaggtcatctcactttgtttaacactgaggaacaccaacgaatcttaacagaaggccagaaatgactccaggccagtgccccaggggatcaactagatgtggcaaactgggcaagggaagacttcttgggggaaggacccccactgggatcatgacaccgaagaggggaagaaataatttggagagatactggcaggccttcctacagggggtcaaagccagggctaaaaagcctaacatggtcaagaccactgaggtgctgcgaaagctggatgaaaaccgggccaacttgtatgagagattacatgaggcttttcggatcttcaccccttttggtcctgaagcccctaaaaaccagtggatgatacatgctacttttgtgggacaagcccaatcagacattcataaaaagttaccgaaattagaaggatttgcaggaaaaaaaagacactgaattactagaaatagccaacaaagttttcattaaccatgaccaaatggcccaccccgatgcagaaaagagaatgaaacaaaaagccacgctttcagtggcagccctgtcaaaactggtacccctagtgggaccaccccataagtcatggggccaaggccaggaaaaaggagccccctcggacattatcagtgtgcctactgtaaagaaaagggacactgggaaaatgaatgctccaattgtccagagagaaagaccaaagtggcacccccacctagctgataccaacccgagccatccagcgcaaatctgatcagcttagatgaagcagaatccaagtagggggaaccagtctctctctaactgggtccccgagagcctatggtcaaaattcaagtagggagccatcccagagactttatgatagatacaggtagtgaacatatggtggtcacataatccatggccaccctcttgggaaaagaaactaccatcataggggccacagatccccaaacacacaggcccttctgcagtcccccatagtgctgttaggaggccatgaggtagtacatgaatttctttacctacctgactgcccatttcccttgatgggaaggacctactggccaagatgggggtgcaaatctcctccaatgatggatcagctcaactcaatagaatctccctctcctttaatcatagctcttcccataaggtgggaagaagaatggtgtctatattcttcccctccagaagagggaaccattcccctgcaactagggactgagtacccattggtttgggctgagagaaaccctccaggaatagcaagacaccacactcctatcttgattgatctgaaacctggagctcaaccagtaaagctatggcagtacttgattcccagagaagctcgactgggaatccaggtgcacctggacaggctacttcagcatgggcttttgataaagtgccagtcaccctggaacacccccttattgcctaaagaaaccaggaactagactaccgcctggttcaggacttgagggccataaatgaagcaagagtcacattgcacctgtccgtgccaaacccgtataccctgctggggctgatcccttccactgccaagtggttcacttgcctggacttaaagatgcctttttctgcctctgagtggcacctgcttgtcagcccttatttgcctttgaatgggaaaatccacacactgggacaaaggagcagctctcttggacaagactcccatgaggattcaaaaactctcctactcttttcagcagtgccctggcctccgacctggctgaatttcctggacaaaaactagactgtgtcttgctacagtatgttgatgagctcttgctggccagcaccatgcaggcccaatgcctagaaggaacaaaagctctcctctccctactaatggaggctgggtattggatatcaaagaaaaaggcacaaatctgtaagaaacaagtcaagtatctgggttttaacatcacacggggctgacaaatgttggggactgaaagaaaagacacagtttgtgccattctggtccctaccaccaactggaagtttcgtgagttcttaggggcagcgggattctggaggatatggacccctggcttttcagacttggccagacctctatatgaggacctgaaagggaaagaaaaggctccccttgaatggggactgaacaaggaggcagcatttcagacaatcaagaccaaagtcactgaggctccagccttagggcttcctgacataatcataaaattcaacctctttgttcatgaggaaaatggaatggccttgagagtcctaacccaagaatttgggccttggcggaggccggtggcatatttgtccaagcaaattgactcagttgtggccagatggcctccctgcctctgagcactgatagctgccaccttgttagtaagggaagctgacaagttgactctgggacagaacctcaatgttaaagtcccacattcagctgtaaccctgatggacaatcggggccaccattggctcacacatgcacaaatgactcaataccaagggttactatgcaaaaatctgtaggtaaatctagaagttgtatgaactctgaacccagccatgtttctaccaaatgaagtggggcccccagaccataactgcttagaggtactagatgaagtgttttccagcagacctgacttaactgataaaccactccaaaatccagacctagttctatatactgatggcagcagcttcatggaggatggaaaaaggatggcaggatatgctgtggtatctgactcagaagtgatggaagcagaagcgcttcctccaggttggtgagcacagagagaattatgggcattaatcagagcactgaagctcagcagaatcaatatctataccaagtcatggtttgcctttgcaactctgcatgtccacagagccttatataaggagagagaactccttattgctaaaggaaaagggatcaaaaaccaggttgaaatcttaaagctcctagaagcagtgtgggagcctaaggaagtggcagttatctactgcaaaggccaccaaaagggaggtgaccccatgacaagaggaaaccgcagtgttgctgcagctgccagaaaaatccaaagtcctgctggccccagaagtgccgactgttcccaagtactctctagaagaggaaaaaatggatcaaagaggatgggggaaccaaaactaagacagggtggtaggtcacacaagatgctgggcttatgttcaaaacagctggcctaccaaccagtccaccagcaacacaaattgactcacatgggcaaaactgccttagagattttactgggtcagtcctacctcattgcacttcttccagcaccctgatcctctgtctcccaactgtgtataacttgtttgcaaaataatgctctccaggggtctagcagaccagctgggacacaacattgtggactgtccccatttaaggatatggaaatggacttcactgaaatcactccaagcagggaatacagatacctgctagtttttgtctgcaccttttcgggatgggtagaagacttcccaacccaaacagaaaaggcaagggaagtagccaaggtactcctgagagacatcattcccagatacagaatgactctgaccattgggtcagacaaccaaccggcatttgtggccgagacagtgaagccaatggcgaaaatcttacagatcctgtggaaactacattctgcctatcaccctcaaagttcagggaaagtagaaagcatgaatcagacccttaaacagacactagcaaagttatgtcaggaaactggcttgccctgggtagacatgttgccagtggccctcataaaagtgagatgctcatcctgaacgggaataggattcttgccatttgaaatcttaaatggaaggatgcctccactgttcagtttggggccaaacaccagagattgggagacttagatttacataaacaactgcaagaattggggctcaccatctcaggaatacacaagtgggtgacagatagaatacccatatccttaggtataatagtgcacccccacaaaccgggggaccacgcatggataaaggattggaaaaaggagcctttaaatccagtatggaaagggccctatactgtaatcttaaccacccccactgctctcaaagtaacaggaatagacacctggatccatcattccagagttaagccggctggccggactgatgtccttggggaatggaaggctgcccttgatccagaaaaaccaccatgtctgacaatacagaggcagagacaacaatctcaaagccctgctctgactacactggaagctggtcagtcgatgcacagctgaagcttgaggaattggctgcccggtgaaacagactgccttattttctatagaaactcccttactgtcatatactgttatcccatgcctgatatgtatgtttgttggttgctgttactaatctggtctccctttgccctgccaggatccatttcctctttcaacccatgcatttgagtaaccccatcagatcagggggttacacggactttgctttactctactcatttgaaagttgtacttacaaaaaaaccacttactctatctgtcaccatgatggccaatatatttgctttgatccacaatactcaccaactgaggaatggttagaggtctggcgctctcataaggcagggcacctgattaattggacccaaatcaccaaccctaaattgctagtatctgtagtttttgatgcctgtgaagctatggatgggtcatggacttctaccagaccatgtgggagcctgtcatgggaaagagaatataggctccaagatacatatatgtgtgattcctcaaccacaactgtctggaatggtggtcaaaatgtcatgagcttctattgctcttactggggctgtgaatcctggacgacttgggataaaggagacaaaaccactgtccttcacaaggacatggcccctccagactgtcagactaagacttgaaacccagttaatttcactatttacaattccaatgagcccaaatggaaggagggtctcattataggcatacgcattaatggaagaggcaatgaccctggagctctgctacatttccagaaggtcacacttatgctccaggctgcctctcacagggttttgcattctttttacaaggaaatgaagaacaccctgcctcccatttcagctacaactaaaaatttgtttttggccctggcagagaccattgcacaaaccctcaaaatctcctcttgctatgtaggtagaggagcaaagatgggagaccactggccttggcaggctagacaactggaccattggagccccataatgaagctgcatagctccaactcaccaatggggtatggcttctcaggactgcttttatgggaaaaactgccttgcaaggtggggaggatggttcagtgtgtcatttgggagcctaatgtgtttaggcctaaggttttataacctaactgcccaaaaggcttgatggtgggcatcttcaaatctctcaaagcccaagtctaatcctctgtctaacatttcccacctctggcaggcatgggacgatgtcagtgccgatatccaatggcaggcgccaaagggattatattggatctttggaaaagtggcatattccgtactccccccatctaggcaggagcacgtgtgctgggaactatcagaccatccttcttcctgctcctgttatcattaggagaacaactgggtgttcctatgtatagggcaccgggcacccagagagactgaagggccctccagattggagactggaaagatgatgagtggcccccagaatgagtaattcaatattatgggcccaccacttgggcagaggctggctcctgggggtaccacacccctatctttatgctgaaccatatcatcagattacaggcagtattagagcttataacaaatgacacagcaagggccctgactatattagcccaacaacaaactaaaatgtataatgccatctaccaaaactgcctagccttggattatttacttgcttctgaaggaggggtttgtggcaaattttttttttttttttttttggtctttttagggctgcacccgcggcatattgaggttcccaggctaggggttgaatcagagctacagctgcaggcctacaccacagccacagcaacacaggatctgaatatcgcctgcaaactacaccacagctcacagcaatgccggatccttaacccactgagcaaggccagggattgaacccacaacctcctggttcctcgtcagattcgttaaccactgaaccacgatgggaactccaggaaaatttatcttaagtaattgttgcctacaaatagatgatacaaaaaaggtgatagaagaaattgccaaccacatgactaaaattgtccatgtgcctgtgcagacttggaagggatgggacacaaacagtctcttcagtggatggttctcctggctaggaggaattaagacaatggtcggattaatcatggccatactcgtggggtacttacttattccctgccttgtacccctcctaatgaatattgtaaaggatttcatagaaaccatagttggaaaacagccaaccacttgctactcatcaaaggttaccagtgggtaatgactgatgatgacctcggacagctgcagatgcaccctgaacatcaaggggggaatgaaacaagagtttttaactagagaaataacccccccaccaccagctgaaaaggttgctacgtgcctgtcagcaactttgctcaccacataccatcctacctgtaatctcagagcagctacgtgccttatgtccttgcttgcagccctgcgaaccatgctccaagcattgcttatcagttttgcttttgtaatcctgcttgcccagctccttaggcaggaactctgtctgttcaggaaaggggagggccggggctgcttgcatgggaaaatcttaagccctggaagtctgtattatataaaagctacccagaacaaaggcctggtgctcagactctggaggcgactcctctgagccctcacca

SEQ ID NO: 105 - DNA, 5695 bp, Artificial
  ss788 sequence
ataatggagaagtgggtggaagacagagacagagaccacaattataaaaatatgatactaaagggaatccaggcagcaggaaagaagttatcaattgaaataaggtaaaagaaatcaatcagggagttcccgtcgtggcgcagtggttaacgaatccgactaggaaccatgaggttgcaggttcggtccctgcccttgctcagtgggttaacgatccagcgttgccctgagctgtggtgtaggttgcagacgcggcttggatcccgcattgctgtggctctggcgtaggccagtggctacagctctgattcaacccctagcctgggaacctccatatgccgcgggagcggcccaagaaatagcaacaacaacaacaacaacaagacaaaaagacaaaaaaaaaaataaaaaaaaataaaaaaattaaaaaaaagaaatcaatcaagagccaatggaaaacacttcagcattcccagagtgcctcagaaaatgcctttgaatctatgctcacaatcactctgactcattggaagggaatgcaatcctgaggttgtatttcatttcctaaagtgccctgacattaggtgtaaatgtcagaaactggaaatagatccaaatacccctacctctgcttactggatgttgcctaatgggtatttaattactgagatatagaagaagaaaagtcagaggataaagaggtctggaggcaagcccacctccaggctgtcaccctccaatgtcatcagtcgggacaggaatctggaataactaaccatgaagactaaagactcttgactccattgagtgactcttagcccccactgagggatagaaagccagagaaactagaacccaatcagtgtgccatatgtaaataggaaggacactggaatagtgaatatcccaaaggaggatagaaatgacagatcctagccagtaccctcaaaggcagatggtccaaagagaggaagaatgatagggccaaaagtgtcttaagctgttactccaactgacccacaaggagttccagctgacactggacttagaaggaaagcttgtcaaattcttagtcaacactggtgccgctcactcaattctgaacaccagaccaggcgaattatatcacaagagttgtaagagtatgggagtatcagggaaagtccaaggaatacgcattcatagagccatttgaatgtaaactggatggacactcactcatccattccttcttgtatgttcctgaatgttctacattcagcttgaaagagatatataaattggaggctactattctcctaaagggagacaaactggagcttggtgtcccattagacaaagggcataagatgataatattaatggctgaggacaaacctctctctggatagaggagtcaatctcttggagttaataccaaggcctgggcctagggatggatgggatgagctacaggagccagttccttgatagttcatctaaaacctggacatacatggaccaacagaaaacagtaccctctccaccaagaggccttactgggcatttcccctgctatacagggcctaattgaccagggccttattagaccatgcctattagtcagcctgtaatacccccattctccctgtaaagaagcctaatggggaatgttagagggtagacgacatcagggcagtcgatgaagctactgaggatatacatctagcatagtagcccctaatccccacatcctgctggccactctactgtccaccaggacctaacatttagtactagatttagaaactgccttcctctatacgccattagcccagagtcacaagaaagttttccttgcatggcaggatccaaatatccagcaaaaacaatactgcttgacagacctgccccaagggttcaaaactccacctctctctctggggaaactttagctaaaaacgtaaaagatctatattttaccctccaggatgatattctgatcaccaactctaaataaggaggcctcttccaaaaatattgtaaccactctgaactacctagctgataaaatatacaagatgtccaataaaaaaggtcaaatatcacaaactagggtgaaatacctaggcctcattctcagagaaggccagagaagcctaccccaggaaaggagagaaaccagttgaagtcaccccttctaaaattagaagacagctagttttagagggttggcaggttttactacatctggattcctaactatgatctaatagctatgtctctatatgaaaagttgaaaggaaagggtgataatccttttgcatcgagttcagaatgtaaaagggcctcttgagaattgagaaagcaatcacttcagtcccctgctccagccctcccagattcaaataaaccctttgacatttatatttatgagagaagaggaatccctcttggggcattagctcaaaaatggaccccttacctggatggttgctaatttctctaaacaattagatcaaaccactaagggatggtcaccttgcagttactacaaccctgctaaggaaggctgaaaagttaatgtttcatcagccaatcaccataaggtttccatactaggttcaggctttagtaagttctatgtttactaaattccaagaatagctatccccctggtcaatttaagttcaggctgtgcttttagacaaccagtggatatcataaaaacttgtcacactaacgcctccctactacccacagaaatagggcctctggaacatgactgtatagaaaccacagacaccatccagaccagtaagcctgacctaggaagcaagcctctctcaatttttgaagaggcatgggtcccagatgggaacggttttatgatagggagaaatgttggtggtatacaagtgacctcctgcatctaagtcatggaggtagaaagcctgcccccaaggacttctgccccaaaggtggagctgagagccctcacttgagccttagagctcagaacagggaggatattaagtataacatagatttctgctgtgcatatgccattctacaggcagacaaggctatttggaaggaaagaggcaagcttactgcagagaataaacaggtgaaacatggcttaagcatattgaagctcttagaagcagtacagtttccaaaaaaaggcagcagtgattcattgcaagggtcaccaaaagagggtgcagaggtaataaagggaaatgaggtagttataactgccaaaagagtggccctagattcagtaacctggcaactacccctcatacctagaaggcagatccatttaattattccccaacctacccaaaggaagaattaaacaaagccccaaaatgagatttcaataaacatctaggagtccatgtgtggctagttaatgaccattggcaatatttctttccccaaactgtggcttgtgaagccatctgggaggctcatcaaggaactcactacaggaaaagagcctcatataatttgttagtggaggtcatggtgactcctggcatagaaagtataatcagtcagatatatgagacatgccccatttgcacaatgaatgaccccaaccttagaccccttggaggctgtcagataaggaccattcagactagagggacatatcctggagaagactggcagattggtttcactgccctgacaagagtgccaggaaacttcaggcatcccttggtgttaatggacacattttctgggtggatagaaactttccctgctagaactagaactgcagctgaagtggctaaggcactactgaaagaaataaccttcaggtttgggctctcaggatccctacaaagtgataatggtcctgcgtttgtgtctcaagtgacaaaggcaataacaggtgccctgggtgtaaaatggaccttgccttcagcctgaagaccgccttgttggtgaaagtagagctatccaaacagaacttgaagtgggccttagccatgttatttgaggaaattcaagaaaattggattaagccgcttccatttccctgccctcatgtggttagcccccaggaataagttaaagtgcatttgaactcccattcctcatgactgagagaaagaacaccataatccccttgaaatggaacaattcaagtgtgtcctccaggtagaagaaactttgaaagctctcagggaatatggtagccaggtgttgcccgtacccactgaccaggccctgcacccattccagccaggagaccaggtgaacctaaaaatctggagaatgggaagccacaaaattagcttactcgtaagtagattggaacccacttggtgatcctaaccacccattcttccctgaaagagagcacttgtgggcacatcacacccagtgaataggaccctaagtcccagccttcggagagacaacctggggcaatgggccaccttaactactcctgtaaacctatttctgacccaaagcttctctcctggaaaacaactaaagtgtgaccagggagatcaggccagcatggtgaaccttgacattgcatgcttttgcctataggtaaaatagacagataccttcattttcaggaaaaaactgacatgtgatcattattgtattctattacgtgggccatgcattttaaaacaggcgctcagggatacaaacactcagagctgaggacaatcaacacatttgaaagctgtggggaagaagctctgttcttccccctgggttatgacattatccaaggtcagccagaagcagttttttgcagaagacagacctgcacccctcagcacccctcaagatcgaggagcaggacaaatgacagagctgggattcgtcactagccaagccgagaaaataaaaatagaatctgggtaataaaataaaatctgacctttttttcttgtttcctttgccttagtctagcttcacttcttgtagggttcaggggtcttgtcctcagcagttcagaccagtgtgcacagtgctgcttccagctctacaattcaagatggccacaggtggaagcaaagacgctgagccccgcactgcaacctggagggagagccgtgagcagcaaggatacaactgtgtgagaactccacctcctccctgctgactagaaccaatgaagcagctaagctacagctccacccaaagggtggtaactctgccccctccctcctgactagaacctaaaaagcagcctccacccaggcctatggcctttcagggagaacttgtgctccagagtactagcttgcacctctccattctttgatcaaataaagccttcctgttcctctgaaccaagcccagtctcattctattggctcaaagatcagcaggcatgacccttgctgaggcctaactcaaaagagttggtaacaacagtagaaacttcctgcacatttctcaactcccctgctgcattctgacctgtggcaatcatctacagatgtgctcttctggcttttgtgattcccagtatagatcctattcacctttctgaggcttatgtgagtaaatagaacctgttagatacaagtaacttggaagctggagccagctaaccttggttctaatctctgcattttactacaaaattgacaacagcgcaaagaatataaaatactgtaagttgacttttttttacccctgcaaaatggggagagaagaaattctg

SEQ ID NO: 106 - DNA, 5633 bp, Artificial
  ss792 sequence
tggtgagccagccaggagccttgctaatttttcccagctggcccaggttggggaattttccagtaaggtcctagcagcttccaggaccacttgtcctgaagatattcccttcataattccctgaaacaccaccagttgcccaagcacttggcgcaaggaattgacatttgagagccaataggctccatccagtaagttgctatggtgtgtacaaatgggaacattcttccctctcaattcaggcttctcctttaaggtaaaagccaatatgttttgcatttaattgggacacattcttggagaggggaactgttgttggactctacctgatttgatttgtgaatcagttcatttgatttttactttgcaattatccatgatgaaatctgtgcttttggcattgggatttttgtgatttttgtgttttgttgttctttaacttatcaatatgggaaatactccacctgttcctaaggaaagccctttggggcatatcttaaataaatgggcaaaatatggctgtgggcctatgagtaagaaagagatgacattctattgcaatagtgtatggtcccaatatgtgctaggatcaaaagagaaatagtttggctcacacaattattatacaatcttgcaattagaattgttttgtgaaatagaaggtaaaaatgatgggattccatatgtagaagcatttatgctattgcatcaggaggaaaagaagtcagatggctgccaccttatggctgccacagcagtctaaaaggaaaatctgtcatataagagagagagggagaaaacgagagtgagcacatgctagttcaaaacttaaaccctctctggcctacctggcaccccactggctgagcaggctacaccagcagttgctcatgccaccatctcttgttactcctccttatggggatcatattataaggttctacattaacccctggggcacagaggttggtttagtgtcatgacctaagactcgacagggcaccaaatttggattgggagccactttcagagcagggctatttcccttgcactaatatcctctatgtgaccttaatgcagatggataactagctgggtttctatggatctacaagcaattctcaactccacatttgtttaattggaaaaaccacaaccctgctaaccaagaggaccccctccatataagtgaacttttcacttctatctttgccacccatcatctctcttgggccaatagtcaccattcacatccttataacatgatgcttactggggatcaaaggaggatggtcattgacaaagctagagaagaagcacaccagcttcatttagcagatccagatgaaacctcagaagcaaatctggcaattcccaatattgtgactgacttggatcctaataatggatatatgctgcaactggagcattatagaaagtgtatcttcatggctttttgaaagggaatacataggccaaagagcttaagtaaaatttaggagaaacagcaaaaactcaatgaggatatattagaatttctagaaagaacttatcaagcttataggcagtgcactacagaccctgaggccaccaaaatatgaaaatggtaaatatgactttcattgggcaaagtactcaagatataagaaggaaattacaaaggttggatggtgcatttggaataaactcttctcagttggtagatgttgcttttaaagtgttcaacaacaagaaacatggacagaagcaaaaggatgtaagatggaacactacttttctggcagcagcattggattcccagaaggcaagtaacctgagagaggtaagcctctactggagagggaacaatgcgcttactgtaaggaggaagggcattagaaaacagggtgtcttgagctaaagaaaaaaacaaaaatcagtaaaagaaagatgagagcctctcatatggtagaaagagaggaacactctgatgaggaatgacaaagtccaggggctcccttggacttgaggtacccaattccaatttcctcacaggagcccctggttactttgacagtgggggacaaattgattgactttctgatagatttgagtgcaacatactctgtgataaacaccaaagtggcacagaaaacatcctgatccatttctgttacgggagtttctaaagtacaaagttgttatttcttacaacctcttacaacctctggcattaggggacctcaccctgaaacacagtttgttatatatgccggtatgtccaattcctcttttcagcctagatctcctttgtaaattaaatgctcaagtaacttttctgccaggagaacttgacatcagaatcccactggagcatgctttgaacctacagatgcactcatgggtacccccagaaaaggaggcagagctctccccaaaacccctgaggtctatgaagagttaagggtggaaatgtaggctggaatagcaccccagggaaggccaacaatgcttggccaatacaaactccattaaatagggatgctgggacacctaatataaaacaagagcctctgaggcaagaagccccaaaggggattcagccggttctcaaaaagtttttgaaaacaggattgattaaaccttgcaggtccccatataacacccctatcctcctggtcaaaaagccaaactcaagagagcatcactttttctaagacttgagtgctattaatgaaatagtccaagatttgtaccctgtggtacctaatccatatacttcgctcacaactattctaggaaaatagagctggttctgttttagacttgagagatgctttgtttgcattcccattgcagaagaatcatagcatctatttgattttgaatggcaggacctagatacacatgtagtccaacattattgttagacagtcctgcctcagagatttaagaattcagttcccctactttgtttgggaaaatgctagccagtgaccttagacacttaatattggatgaaggactcttactccaacatatggatgatttgctcatagcaagccctacatatgataagtgtctacaaaataccatcagaaccctaaaatatttggccactcgtggatataaggtttcctagaaaaaggcccaagtgtgtaagcaacaagccacatatctgggttttgtcttttcctatggctagtggagtcttttgcctgatagaaaacaggcaattgcaggcttgggaacacctaagacctgcagataactggggtggtttgggggaatgacaggttctgttggattcagatctaaaaccatgggcttatagtaaagcgctcctatgaggctttaaagggacatgaccttgagccccttacatggactaaagagtgctaaaagctttttttttctttttctttttttttttttctttttagggcctcacttgcggcatatggaggttcccaggctaggggtcgaattggaactacagctgccagcctatgccatagccacagcaacatcaggtctgagccgcatctgcaatctataccacagctcatggcaatgccagatccttaacccactgagcaaggccagggattgaacccgcaacctcatagttcctagtcagattcgtttccactgtgccacgacgggaactcctaaacagccttttaaactataaagacagttagtctcagccccggctttggaactcttggacttaaagaaacctttcaaattgtatgtccatgagagacagggcattaggttcagggaatatccctcaacctgttgcctacttctcaaaacaaagaacagataattaaggaagggatggtccccttgtcttggggtcgaattggaactacagctgccagcctatgccacagcaccactgcgtatgtccctaaccatgtcccttctttactggaacaacaacaacaaaaaggctattgggtgacttccaagaggatgggaaagtaccaagctattctcttacacaatcccaatgtaagacttcaggtcacttcagccctgaatccagccacattgctcccagctgaggctgcaccattgtcatagcataactgcctacatgtcattgagtaggtgtactctagcagactggacttaatggaccaatccctgaatgagccagatatggactgtttactgatggaagcagcctcatggaccaaggtaggcaacacaatgcgtatgcaatggtaaaccttaaaaatgctattaaatcaaaagccctgcacccagggagctcagctcagaaggcagagattattgctctggcaagagccgtactactcactgaaggaaagtgagtaaatatatacataaactctcgctctgcattctctgtggtgcacgctcacagggcaatctggaaagaaagggggctcttcacttcaaacaataaagacataaaacataattctgaaatcctgtcactattagaagtactctataagccttcacaagtggccacaatgcacttcccaggccaccaaaagggtgaaattcatataataaaaggcaaccagctagctgacctacctgcaaagaaagcaacaaaggaaggggattatcaagccatgatagggtcacttctcccacagactaccttgtccaaatatataccattatattcagaaaaggacaaaaagagggccaaagagtggggattcactcttgaccataccccacctgactgaaaatgtagtacacaaggaattgttttgatcgctgaggttgtctcggaccctgtgctacaacacattcataatagtacccaatacaggatagatgccgccttacaatggattcaaaaacatgtaacgggacccaaccagtaagtcacttgaaattgctaaaaataatccaaagactgctgtcagacctccccagaggggagaccaacacagaggaacctgccccactgaggactggcaaacatactttacttaaatgccttgagccacaggaaattcaatacacctgctagtatttgtggacacttttttcaggattggtgaaggtataacccgccaggacagaaaaagccttcaaagtagatagagccctccttaagggctctaaggaaatttccccctgatttggactacctactcccttcaaagtgataatgggcttgcttgttccctagcataaccccacaagtgtctaaagcactgcaaattggaggctacattcattctgagaccacaatcaacaggaaagattgagaaaatgagacatacattaaagagtattcctaaaatatgttaagagatttaactggggataaggccctgctaccagtcagaatggctcccagaatcaggcttaaattaagcccttttaaaatattgtatggtaggcctggagcagggaatctataaatgttctaaaagatctaacagttgccaattatgttaaagctttgggcactatactaacctcttttcatgagtttgcttccaacaggtctttctatcaactgaggtaggcttacatcctttctgatcttgagattgagtcctccttaaaacctggagaaacaagggcttgagcatcagctgactgctaggtggacaggacgacatgtggtattacttaccacacactca

SEQ ID NO: 107 - DNA, 9662 bp, Artificial
  ss797 sequence
tgtgtttatctgtcactggtaaagcccattaacaatttctaggaaataaaaatagaatctgggtaataaaacgaaatctaaccttttttttttccttttcctttgtgcttagactagtttctcttgctcatagagtaccacacgtagagagaggccttgcagctggcccatcggaccagagttcccagtgggaaatggctgcaccctacacctcagcttggcacgccgagtgcagaactgctacacctggtactatgatctggagccatgagcagcacagctatacctgactcacaagaactctgcaccctccctgctgataagaacctgataaaacagccctgagatggtctgttggggacagcatgtagagcacaagcttgcacctctccaattgtcaatcaaagaattttgcttctgagcagaacttgatctcattctactggctcatataacaccaggcaggaggacccttgttggggctcatctcaaaggattggtaacggggtgtggggggggggagcgagaaattgggaacgtgggaataacgaatacacactactgtataaacaaattattaataaaaacctactgtgtagaacgggaaaatctactcaatagtttgttataacctctatgggaaaaaagaatggatatatttatatgtatgactgattcgctttgttgtacacctgaaactaatacaacattgttaagtcaactatactccaattgattttttttaaatggaggactggtaacaaattgtggcaaccacgaaagaacaaaccatagcctttcacctgcctctatccagtaggctccaagcttgcccagctccagcgggaggacggtgggggctctaggaagtctgagtgaggatgactgactttggtcattgactctggctggcctttgagttcactctgatggggtagaacggcggcagctgaattcagagaaactctttccagcaccttgatatggtatggtatgcatatagcatagcccccagaaaaatctggaccatgtacccttgaggggattacactgactcaaattcaagtgtgcctttcgatggtgctcagtggagagggggtggggcagggggtggtggggtcttgcagatgggatgaagccatggaagtcttgccagcaatgctatcctcttgatccctgtgaaaggcagtagtggccacaccagggctttttgccctcctccctgatcacgttctccatagtcactttcagtttagtaaagggaagtggccagtcccatgaaccaagaggagagaccagaaaaaggcccaggtaaagaagaccacctgacacaacacaacaaggatgttccacttgagttcaggaaagggcactgggaagcccgaatgtgaaagggtccaaaggtgggtatacagccggtaattgaacctctttgggccagcgctagtttctcagaagtggactagggagtcctgtgagctgttcacaagaccaggaacccccttatcaggaaactgagctgctggcaagagcaggaaacacccaccaccaaacctctcttccctttcctgcttgtgaggtgaaacgggggattctctattgactgaggttccacagactctcctctccgtatcaggacagaataccagctgccccagagatttggtgagtaccctgtgagaatccctcgtgcttttagctctcaccttgtgggaagcccccaaactcttccttttcagcccaaggtcaggaagagaagacccccacctcagacagctaagccactccctaatggaccaagttggtcaggagctcaccacgctgctctggcccagaggcagtgctgtctaacctcctgtgggacatcctgactgaggagagacgtactatctcaagcacaagcttttacaaattcaagacccccaccccccaccccccgttatatcagagtccatgcgatttgaaggcctcctattttggtcttttgatttattttttattattaatgttttgtctttttagggctgcactcatggcatatggaagttcccaggctaggggttgaatcagaaccacagctaccagcctacaccatagccacagccacgccagatccaagccacatctgcaacccgcaccacagctcatggcaaccctggatctttaacccactgagtgaggctagggatcaaacgcatgtccttatggatactcgtcaggttcattaccactgagccatgacgggaactccctgttttggtcttttgagaaaaccattaatatttttattaatatttaaatttcccaagccagaagtcttctttgggtcaaatccagcatttgctagcctacaattcctctaaccacccccttggtagctagaaacaaatccaaaacagaacatctaaggtatgggaaaccaaacgtccaccctatcaaaggatagcccattagggtgcatcctacagaaatggaagtttttcgggtatcatcccctgaccctcaaaacatttaatcttcctatgtaatacagcctggctctaataccacctgtgagatggggaaagctggcttgccaatggatttctaaattacaacatccttttacaactggacctgctatgtcagagacaaaagaaatgggatgaaattccctatgtccagctttttttgtgggcttgtatcagaacagagaccttcgaaagggatgtaggctcttctccgttgagataatactagtccttgaccctcccccgaggaccttcttggtctcttccctaaccctccctgctccctccctacctccttccttcttaggtcccaatttgggccaaaggcctaatggcccccttctataccagtgcccttcctcagaacccagtccagcaaccacatagagcaggaccaaccagagtccaaggagccaccaggaaaagtcctctctttgaggcagaaggtaggctcatccaggtatatgtcccatttaccactcctgatctgtataactggagaagtcatagcaaggggttggggaaagatagaggggttcctgaatctgactagggaaatctttcagacctaagaccccacctgagctgacatccagagcctcctcaatgtactcctagcagaagaagaaaaggccaccatcttttcaggagcccggacaaagcaaacagagacagaacagtgctggtcatgctcttttcagatggaggaatcaagtggtcccagataataaacacaactgggaccacagagacaacagagaatggggtggaagacaggttgatccactataaaaatatgatcctaaagggaccaggcagcggcaagaaacctgtcagttggaataagataaaggaaatcatttgggagctggtgggaaacccttctttggtattcttagagtctcagggaatgcctctgaatctgtatcaccactgatcctgagtctttagaaggcaacacaatcctgaggtcatatttcatttctcaaagtgccctgacattaagcataaatttcagaaattgcaaatagaaccatgtacccctaccttcatctggttgtggttgcccactgggtgtttgatatatagaggaggaaaagtcagaggataaaaagacctggaggcaagcccacctactggctgtcaccttccaatgtcaactggtcagtataggaatctggcctaactgcccatggagactggcgactcttgactccatttgattgacccccgctcctcactgagggatagcgagccaaggacacttggacccaaccagtgaaccatatataaacaagaggaacactggagaatgccctcgctgcccccaaagagggaggaaatgacagatcctggccactatccttgaaagcaaatagtccaaatagatgaagaatgatggagccagggggctcctaagctgccgctccaactgacccccaaggagccccagccaacgttggacatagggggaaagactgttaaatgcttagtcgacactggggcaacttactcagttctgaacaccaggtcaggaaaattcagtcacaagagttataaaattatgagggtatcagggaagatccaagaatagtcattcatggaccattagaatacgtgctcaaccatccattcctgtatgtccccgaatgttcctacccctctaagaagaaatatcttacaaaaattgggggctattagccgaatgagagacaaactagagatgagtatctcttagatagggacacaaggtgagcatgttaatggctgaggacacgtccctggacagggcaaatcagtcttcctggagtaaatccccaggtctgggtaggatgagctgtaggaaccagccctgtgataattcatctaaaacacaggcatatacagcacaatagaaaacaagacttccccatcagaaggccttattagactatgtcaatcagcttataatgcccccattctccctgtaaagaaacccagtgtgaatatgtgatggcacaccacttcagggcattcaaggaagccactgaggatatacacccagtagtccctaatctctacattctgctggtccctctacaatccgccaggaccctggtattctgtactagacttaaaagatggtttcttttgtattccattagctccagagtcatgagaaatttctgagtttgagtggtaggacccaaccattctatacaaacaacaatcttgctggagagctctgccccaaaggttcaaaaattcccccaccctctttggggaaactttagctaaagacctaaaagacctacatctggaggtgggaaccctcctctggtatgcagacaatgttccgatcactagccctactaaggaggcttctgacaaaaatagcgtaactactctgaaacacttagccaataaaggatgtaaggtacccaagaaaaaggctcaaacatcacaaacgagggtgactaatccaggcttcattctcacagaaggtcagagaaccctgctaggaaaagaaagaaaccttcagcagccttggccctcctaaatctagaagacagcttgggggtttcctggggctggctgggttttgctgcatctggatctggatccctaactatggtctaatagctaggcctctatatgaaaggttgaaaggaaaggatgatgatccctttgatggaattcaaaatgcaaaggagccttgcaagtactaaaaaagcaattattgcaagcccctgccctggccctcccagatttggcttaaccttttgacctttacattcaagagagaaggggaattggccttaggatattagctaaaaaaactggggcctcccaactcaggtggctgcttatttctctaaacaattaacccctaaagaatggcctccttgcttccaggcagtagcagctacatcaatccttctttaactgaaaaattagcatttggtcagccagttgctgtatggattccacatcagtttcaatctttagtaagttctaaaggaacagaaaggcaaatctctggaacgtcattcaagttcaggatgtgcttttagacaagccagtggctaccataaaatcctgccccccactaaattcttcccacagaaacggggcccctggagcatgcctgtatagaaaccacagacatggtctatgccagtcaccctgacctaaaaagtgagcctctcccaaaggcagaagaggaatgattcacaggtgagagaggttttatgagagggaaataggctggtgagatacacagtgacttacagatctaagaaagatctaagaggcacgaagccctcccccagggactttagcccagaaaccaaattgacagccctcacctgagccttagaacttaggccagggaaggtcttgaatgtttacacagattcccggtgtgcatatgccatcttctctccccacctcaccccaccaacacagggctatttggaaggaaagaggtatgtttattgcaaagaataaacaggtgaaacatggcttaagcaaactgaagttcacagaagcagtacagctttcaaaaaaaaggtggcagtgattcattgcaggggtcaccaaaaggggacacaggtaacacgtgggaaacaatgaggaggatacaactgccaaaagaacagccctagaaccagtaacctggcaactacccttcatttctcaaaggccagatccatccaactgctccccagtctataaaagaaaaattagacagagcccccaaatgaggctttgtggggaaaatggagtcactcaggctcttttcgcttgacatcctcttgacagccatattgttctggtgaaggatgacttagcaactcttacgtaacaatgttcaactagtggcatgcacagtgtggtgggatgacgaccacctcttatgcaacattttggcaaactgccggctttgttctgcactggtatataaggcagtcaggactttccagcctgatgcccttgccgcccatgaaactaataaaaactaataaagtgacatctaacctaactgccgctcactgaatcttctttcaagtgcctgaatccagggtgaacctgcctgatcttgagagacggcagaacaggcttcagcagagctctaggaggccatgtgtaggtagttactgaccatgggcaatactcatggtcagtaattccccaaactgcagcttgtcaagccgtcagggaggctcatcaaagaactcattacaggagggaagccctccataattggttaattgaggtcatggggactcctcgcatcaaaagtgtaatcagttggatagttgagacctgccctgtctgcacaatgaattccaactccagatcccttagagacccccagataaagcccattcggattagaacgacatgccctggagaagactggcagattaattacactgtcatgcagagaatactgggcaatttcaggtatcttgctgctaagcggacatttttctgggcggatagaagcatttcccctgaaaactgaaatagcagctgaaggggctagggcattactaaaaggaataagtcttaggtttgggctccccaggatccccacaacgcaataacgtcccaacatatgtgtctcaagtgacaaagggcataacatggaccttgcactcaacctggagaccccaataatcagggaaagtacagagatacagtcaggccttgaaacaggccatagacaagctgtcaggaactgaagaaaactggattaggttgcttccaattgccctgcttgccatgtggttagccacaaggaatgagttaaaaaggacatttgaacattccccatgcctgcgagaagggacaccttaatctccttgaaaaggacagctcagtatgctgtccaggtaggagaaaccttgaaagctctcatggaatatggttatctggtgctgttcccagccatgaacctggccctccacccctttaggccaggagaacaggtgaatctaaaaacctggaaaacctgcagtctgcaagatcagcccactttgtgacgctaaccatccaatgtgccctgaagtcgcagcgatcactttgtgggcacatcacacttgagtgaagagggcccgcgagcctcagtctctggagggacaacctggggtaacaggcccccttgaatacacaggtaaacctctcttgggcctgaagcttctcttccaaaaaacaacaaagtgtgatggcagtgagcctccacatcagggcatgcttgcccacaggcaaaaggcctagatacctgcattaaaaaaatttttttttgacatatgaccatcattcttgtgctaatatttgggccatgaatcttaaattgtttggtggtctttgtctccaaaaggttagacaaaggatggactcagggctgaggtctgaggacaatcaaacataacgaaaggcagctggggagaaggtcggctcttctaccccagaatatgaagacgcccaaaccagccagaagcagtttccgaagacgaaccttcacccctcagcgtccctcaagaatgaggagtaggacaagcgacagaggagggatttatcaccagcaaagcccattaacaattccccagaaataaagatagaatctgggtaataaaattaagtctgacctttttcttttcctttgtgcttcttctagtgacatttgcgcatagggtgcctggtgcagaggctttgcccctagcacttcagatcagagttcctagtgcaaaacgactgtgccaacacctcagcttgggactgcgcacagaagcgctgctcaggaaatctcagtccaaggtggcactgttggctgtgtgcagagacgctaagcagctctgctgcgcctgcgcgagagaactccgccccctccctggaggagggcccatgaagcagccccgcccacagcctgtcatgtgacatctgtgctttggagtgagagcgagcacctctccatcctttcatggaaaactaaagctttcctttgcttctgaactgaacttggtcttattctattggcaaaagctactccaggcaggaggacccttgttgggaactgactctaaagggtaggaaatatacttttctttttttttttttgctttttagggctacactcgtggcatatggaggttcccaggctaggggtcgaattggagctacagctgctggcctatgtcacagccacagcaatgcaggatccgagctgcatctgtgagctacaccacagctcacggcaacactggatccttaacccaccaagggaggcagggatggaaccccgcaaccttacggttcctagttggatttgtttctgctgcaccacaacaggaactctggaaatatatcttttaagtatttatgcagagtgcagccaggagacagaaaccacatcagttacttgaacagagagaatttaatataaaagtctgttaactaggtatagcattgttaattgaatactttgaaaggtaaaatgagaactataaggtctaacagagatagcaatttcagaaagcagctatcaccctagggatgagagaacacaggggggaaagtttagaattttaaaacttttgagacttggtgggaggaccctgtgagttgaaactgctgagaaggggacactgctgagcaggtgttgatgtctctggttggatgtgatgaagctaattctgtgttgaaaaactgcacactggcttcagctatgctatggggtgacctcactgctaccatggtcaaaaagtgttgctgggtgatggagcatgccactcaacaaactcatcttcatccctgaagacccagttcagatgtcacctcccccaagaagtcttcctgatttcttcctttagacaggaaccccacaggaagcagacaggaaggaacaagtctcatcttccctctccagctggaaggcccgctctagcatccctattgacagaacttaaatggaagttatctggccaagcaaaaatgtgacttgcagcaacctagccccatcatcacaaagcagagtacagaagagtttgggagctgagacaccatggtggcataattaggacaggagtctgcctatcaaagctgtggtacaggaactgctgttactcccattatacagatgagggtctagagaagtaagggtacttg

SEQ ID NO: 108 - DNA, 9638 bp, Artificial
  ss802 sequence
tgtaaaattaaaaggaaaaacttccttcttccgtactgtatgcattgaaaagaatgtttgttatattttgtgcagtatttgtggcaggagaattttttgattatctagtcttccacattggaaagggaaatgtcctctcctgatcttttcagcattaatagcaacgtttattattattcccttttcatctctatggaccctataacatttattttttttttttttttttttttttttttttttttttttttttttttttttgttggtgttgttgctgttgttgctatttcttgggctgctcctgcggcatatggaggttcccaggctaggggttgaatcggagctgtagccaccggcctgcgccaaaaccacagcaacgcgggatccgagccgcgtctgcaacctacaccacagctcacgggaacgccggatcgttaaccccctgagcaagggcagggaccgaacccccaacctcatggttcctagtcggattcgttaaccactgcgccacgaagggaactcccctataacatttatattataacaaacctattaacatttgttacatattaattaaactggaccctatcacttcttgttctattgggttgataacacatcgtctcatctaccagtcacagtgttgcagaaaccgcaaaaaccgtggcaacggaaggagacaaacagcactcggagatatggaaaagcaaggtttattcagcaccggtgcgggctcagaggagtcacctccagagtctgagcaccaggtctttgttctcagtaacttttatacactacaaggtcttgattttgccatgtaagcatcccggacctcccccatccccaggcagacagtgtccctccctaagaaactgagcaagcaaggttacagaagcagaactgataagcaatgctgggtacctgattagcagggctgctggcttggacagagagcacacagttgttacattattacgagaagggtggcataatgattagccagctggaaaggcttgtagctgccttcttagccaagggggggttgttctttagttaaaacttcatttcaacagtgctgattttagcagccaatccgagtttcaagaaacaactctacacttagcaaaagcctctttgacgccctgcctttgaacgtttttattattaccagcccttttccactgccgatctcctcaactggaaaccccatactccctcatattctgaaaagcctcaggtgctgatcgatctcttagaattcattttccagacacactgtcccacctggatagactgccggcaactcctttttactctacttgacactgaagagtgctggcgaattgtaacagaagcccaaaaatggcttcaggtcaatgcggggggtcgagcagacttgcaaactgggtgagggaagccttcccagaagaaaacccccactgggactatgacactgaggaagggaaacgtaacctagagaggtaccggcaggccttcctacagggggcaaaagctgggggtaacaagcccactaatatagctaagatcagtgagatactacaagagccaaatgaaagcccagccaaattctatgagaaattatgtgaggctttccgaacctacactccttttgatcccgaggcccctgagaaccaacggatgataaatgctgcctttgtgggacaagcccaattagatatccgtaaaaagctacagaaattagaaggctttgcaggtgagaatgccactaaactgttggaaatagcccacaaggtttttattaaccgagaccaggtggcccgccgtgatgcagaaaagagaatgaaacaaaaagtgacccttctggcagccgccctgtcaaaaccggtgcccccattgggaccaccccgtaggggacaaggcacaaggccagggaaaaggagtcccctggaacatgaccaatgtgcttactgcaaagaaaagggacattggaaaaatgaatgccccaaccgtcctgagaaaaagagcaaggccccacctagtcggtaccgatctgagccattcagcaccaacctgatcggcctagctgagtctgattaggggggaccaggctctctccaactgggccccctagagcctatggtcagaattcaagtagggggccaccccatagactttatggttgacacaggtgccgaactttctgtggttacacaacctgtggctcccctctcggggaaagaaaccaccgttgttggggccacgggtaaccaaacccacaggcccttctgtggtcctcgacgatgtcggttaggaggccatgaagtaatgcatgaatttctttacctgcctgactgcccagtccccctgatgggaatagacctgctggctaaaatgggggcacaaatttccttttctactgacgaatcggcccaacttaaattgacagaacccctctctcctttaatcatggctcttgctgtaaaaagggaagaggaatggcgcttgttctctcccccttcagaaatggggaccattcccccagaactagagactaaatacccattggtttgggctgaaggaaacccaccaggactggcaaaacgccacgctcctgtcttaatcgatctaaaacccggagctcaaccggtaaagctacagcaatactcaattcccagagaagctcgactgggaatccaggttcacctggataggctgcttcagcatggactgttaattaaatgtcagtccccttggaacacccctttactgcccgtgaaaaaaccgggaacacaggactaccgcccagtacaggacttgagggccataaatgaagcaacagtcacattacacccgtccgtatcccctgctagggctgatcccctccactgctgaggggtttacttgcctggacttaaaagacgcttttttctgcctccgggtggcacctgccagtcagcccttgtttgcttttgaatgggagaatccacatacagggacaaaggacagctcacctggactagactcccacaagaattcaaaaactctcccactctttttagcggcgccttagctgctgacctggctgaatttcctggacaaaaactgggctgtgttttgctacagtatgttgacgacctcttactagctggcaccacggaggctcagtgcctagagggaacaagagctctcctttccctactgatggaggcagggtatcgggtatcaaagaaaaaggcacaaatctacaaaaaacaagtcaagtatctgggcttcaacatcatgcagggccgacgaatgctggggactgaaagaaagcaggcagtttgtgccattcctgtccctaccacccgccggaaggttcgtgagttcctaggggcagcaggattctgccggatatggatccccgggttttcagacctggccaggcctctgtatgaggctctaaaagggaaaaaagaggctccccttaaatggggaccaagccaggaaacagcgtttcagacaatcaaaactaaactcactgaggctccagccttgggacttcctgatgtaaccagagaatttaacctgtttgttcatgagaaaaatgggatggctttggcagtcttaactcaagaatttgggccttggcagaggccagtggcatatctgtctaaacaaattgactcagttgctgccggatggcctccctgcctccgagcgctggcagctaccaccttgttggtaagagaggctgacaagttgaccctgggacaaaacctcaatgttaaagtcccacactcagttgtaaccctaatggataccaggggccaccattggctcacacatgcacgaatgactcaatatcaagggttactatgtgaaaatccacgggtaaaactggaggttgtacgaactctgaacccagccacttttctgccagatgaagcggggcccccagaccataactgcctggaggtactagatgaggtattttccagcaggcctgacttgactgataaaccactccaaaatcctgacctggttttatatactgatggcagcagctttatggaggatggaaaaaggatggcaggatatgctgtggtatctgacttaaaagtgataaaagcagaggtgcttcctcaaggctggtcagcacagagagcagaattatgggccttaatcagagcactggaactcagccaagaccagcgagttaatacctataccgactcacgatatgcctttgccactttacatgttcatggagccttatataaagaaagagggctcctcactgctgaaggaaaaggaattaaaaaccaggctgaaatcttaaagctcctagtggcagtatgggaacctaaagaagttgcagttacccactgtaaaggccaccaaaagggggatgacccagtggcaaaaggaaaccgtagtgctatgcagctgccagacaggcagcccggggacaacagccagacaaacctaaggtcttgctggccccagaagtgccagctgtccccaaatattctccagaggaagaaaaatggataagggaggaaggaggaactaaaactaaaatggggtggtgggtcacacgggaccaccgagtttacattccagaacagctggcctacaaactagtccgccaagaacatgcgctaacccacatgggcaaaactgccttagagaccctactgggccggtactatctcattgctcgtcttcctgcactctgctcctctgtctcccaaagatgcataacctgtttacagaataatgcccgccaggggccccacagaccagctggggcacagcactgcggactgtccccatttgaggatatggaagtggactttactgaggtcactcctagtaaggggtacaaatatgtactagtttttatctgtacattttcaggatgggtagaggccttccctaccggaactgaaaaggcaagaaaagtaaccaagacactcctgagagacattattcccagatatggaatgcctctgaccatcgggtcagataatggaccagcatttgtggccgaaatagtacaacaggtggcaaaagctttacagatccgatggaaactacactctgcgtatcgctctcaaagttcagggaaagtagaacgcatgaaccgaactcttaaacagaccctggcaaagttatgtcaagaaactggcttgccctgggtagacacgttgccggtggccctcttaaaagtgagatgctcaccccgagcaggaacaggattctcgccatttaaaatcttatatggaaggccacctccactaatcagtttaaaaggaaacaccagggagttgggagacttggaattacataaacaattacaaggactggggctcactatttctcggatacatagatgggtcacagacagaatacctgtgtccttaggtataacagttcacccccacaagccgggggaccaggtgtggataaaggactggaaaaaggagcctttgaagccggtatggaaggacccctatactgtaattctaaccacccccactgctcttaaagtaacaggaatagatgcttggatccaccattctagagtaaaaccggctggcacagctgacgaccttggagagtgggagactgccctccatccggagagacctcttcgcctgacaatgcagagaaggagacgacgatctcaaagccctgctctgaccacaccggaagctggtcagtcaacgcacggctgaagcttgaggaatcggttgcctgtgagcccaaatggaaggagggtttcaaaataaacattcgcattgacggaagaggctttgaccctggagctgtgttacatttccagagaatcacatttgcgctccaagctgcctctcacagcatctttcattccttttatgaagagataagaaacaccccacctcccattccggccacaactacgaacttgttcttagccctgacagaaactattacacaaactctcaaggtctcctcttgttatgtatgcgggggaacaaacacaggagaccactggccttggcaagccagagagctggacccattagagcctcctaatgagactgcatacccccaactcaccaatggggtatggctcctcagaactgctattatagggagaaattgtcttgcgaggcggggaggacggtttaatgtttcagttggaagcctaacatgattataaggccgaaggtattatgatctgactgcccaaaagactcaatggtggtcatcctctaatcgctcagagcccaagcctaatcccttgtctaacttttcccaccttcgacaagcatgggaagatatcagtactaatatccagtggcagccaccaaagggattatattggatttgtggaaaaatggcctattccatactccccccaacttgggctggggcatgtgtactgggaacaatcagaccttccttcttcctgctcccactgtcactaggagagcaactgggagttcctatatatagggcacagggtgcccagagagaccggagggctctccaaattggagagtggaaagatgataaatggcccccagaacggataattcaatattatgaacctgccacctgggcagaggatggctcttggggatatcgcacccctatctatatgctgaaccgcatcatcagactacaggcggttttggaacttataacaaatgacactgcaagggccttgactatattggcccaacaacaaactaaaatgtacagtgcaatctaccaaaatcgcttggccttggattatttgcttctgaaggaggggtttgtggaaaatttaacttaagtaattgctgtctacaaatagatgacaccggaaaggtggtagaagaaattgctgaccgcatgactaaactagcccatgtacctgtacaaacttggaaaggatgggatgcagacagtctctttggtaaatggttctcttggttgggaggaattaagacaatggtcggaatagtcatggttatactcgcagggtgcctacttgttccctgccttgtacttctcctgataaatattgtaaaatgttttataaagaccatggttgaaagaaaaacagcctcccacctgctacttattagaggctaccaaagggttatgcctgatgatgatgtgtaaagggtgcagatgcgccctgaacatcaagagggggaatgaaatggagctttaattaaagaacaaccccccccttggccaagacagctaaagcctttccagctggctaatcattatgccacccttctcgtaataatgtaacaactgtgtgctctctgtccaagccagcagccctgctaatcaggtacccagcattgcttatcagttctgcttctgtaaccttgcttgctcagtttcttagggagggacactgtctgcttggggatgggggaggtccgggatgcttacatgggaaaatcaagaccttgtagtgtataaaagttactgagaacaaagacctggtgctcagactctggaggtgactcctctgagcccgcaccggtgctgaataaaccttgcttttccatatctccgagtgctgtttgtctccttccgttgccacagtttttgcggtttccgcaacaccttcagctaggctccagggacaggtagggaaagtggaaagggggtattcttctccccttctctgattagctggagattttactaagtagacccattctttgctgcctaggccagggaggctctttagaatcacctgggggatactttctaaatattgatgcctaggctctacccccccaggggactctgattcagtagtgtgggctccggatgtgggtgttttgaacctatggtgatttttattaagggtggcatggcgtatgtaaatatacattatcttttaggccttttgaaaaataataaaaaccgcctgtgatctgagggtccacttggttcaattcccctcccggggctaaggacgtctccggcaaagggcaggcccccacccccacccccacccccaccccaacggtgaactccagctaagcttagcgcttgcccaccgcgggttcccttaacactccccgccctcaaaggagcaggccccgcccccgtccccgcgcaggcgcacggcgcctacctgcttccggtgcactgctacttaagcgctgggggcgtaggcgctgtcagcctgcgaccgagtcgggcaggctgtgtgacattcgctgtgccatcctgtacctggaaccgtttgagctatgcctttggccacgtctctgccccgccgtgtatttgtggtgggggtcggcatgaccaaggtaaacagagcagtgggacccccgcaggtgggcatatcggggcttggcgttgtgtcagtcggtcctgcctacccggagggcgccctgggcaccccatcgcccagctcggccttggccttggccctgggggcgacagagtggcgactcgggtaggttgtgagatgggttgtgatgtaagctgactttgcaggatcgtaatgtcgcaggcttgttcctttggccgtacgttcctccgttccttttcctccctggatgtcgctgtttgtgaaggatccccgagataacccaaagtccgtagcacctttgaatctgagtggaatcgtaaggtttgtggatctttgattgtggcaaggcccgcttgacacccgaaaggagagcaggtcgccagtttgcacttccatgaatattccctgtgggtcccttctcagggcctgttccaagtgtggatgagaaggagaggcgtgagtgatgctccgcgtctcgccacgcgtggcgggttttctggatcttctaacctttgtgtttctcagggggtgcacggcgtggtattcaggaggccagaggctccccttaccgtctcagttcttggcacccgcaccagccctgttctccaataacgccaaaccgcctttttcgcaccacacattttttatgcctcggatgctttgctttctattgttttcactacttgtcttcacttggttcacttattcgcatttttaaaagattaattcagatcttctccaagaagcctctgatcctcctgactttcccacagagctctgtacttacctctgtcttagtacttcctattttatactgaaattccatttatatgcctatattagcatgtcagatcttccaagtgagtgtaccttgcctaattcattgctatacctctagcaccttgaaaatgcctcgtgcccgaagaccctcagtgaatgttagttaaacaaatattaaatggatatgctttctgaaagagagttcctagaagaagttctctttctgaggaaaaaggcttaggctttttattatcttacccagtgggctgagagtacacacagcaatcaaaacatataaatagataactcaagtaatacctttttttttccctctctttttgtctttttaggcccacacccgcggcatatggaggttcccaggctaggggttgaatcgaagctgtagccaccggcctacaccagagccatagcaacgccagagccgaacctcgagtctgtgacctacaccacagctcatggcagtgctggatccttaacccactgagcgaggccaggcatcgaacccacaacctcatggttcccagtcggattcgttaaccactgagccaca

SEQ ID NO: 109 - DNA, 5669 bp, Artificial
  ss908 sequence
ttaaaataataaaagaactacatcctgcacctacagccccctcctcacttgatgtaatcctaaaaacacaataaaaacagtgtggtttcttgaggtggtgctcttgatccatgagatcttgagtccccccattcccagctttgattaaattaaacgtctctgtgtcttgttttatattaaccttttcttcagcttcacagctcctgtttttcagccctcacctgctgagctggtctcagcaagtggtgcccaacatggggctcaaagacagaagggcctcgatgacagcggatctccactccactggaagtgctttggagccctcagatcaaggaagaatttcacttggccacgctaaagaaatcctgctggtaagttccttctctcaggtatttacagggaaacatgggaaatcatgtaaatgcaggtcactatggtccttctatttgtctgttagaaaaactccttaaagcaggggatgcaaaaacaagtgaaggcaggcttttggaacttctgcagacgatggagaaacattgtgattgggttcctacgttagggatgttagatctaaaaacatggggacaggtaggaacggaacataaaacattacgtgatgagggtgttccgattcctgtgtccatttggagcacgtggagtttaattaaatcagtttgggaacatttgcagactatggaggacctagaggaagaagaaggagtgcttacccatttgtttgaggaacctgaatgtacagtccctgaacacaattgtcataaagcacctttggctcctgagcctttggctccaatttgtcctccttctgattttgatatcccccagtggccccctataaggagtgaggtgaggaggactcatcgagcctccgcttcttcttgggttgtaaagaaaatgagcgttatccctgagcgccatctgttgtccattcaacagggaattttacaggctcaaagggaaggcgatttggatgctacacatctagcctctccagtaactgtcagggaagcagtggctccaggcattgatcccgccaaccccgatggagttcatgatgcgagattccctgggactacactccgcaggagccaggggggttcagcatcgcaatagagctccctagtttacagggtttgattctccttcctagtgaagctcctgcttctagtacaactaaattggaaaaaccattattggcagatactgtaggattgatgataggaagggcagggctaacagaacaaggggtttggattcacaccgggatattggataatgtaggggatggtaaagtacaagtgatggtttccaccgcggttccttggaaaattaataagggggatcggattgctcaggttgcccgtacaaaagggagaagaggggaatagtcttagaaggggttcaataccactggaggagcaggcgtgtttttgtcagaacaggtcctagaggaatgacccacttgtcaagttgtcataaacggaaagtcttttagaggattgattgatactggggctgatgtttcagtcattagccatttacactggcccaacacctggcctcttcagccaccagtatggaagtcactgggtctggaaaagcggagggtctcagaacgagtgcccgatggcttaattgtgaaggaccagaggggcaaccagccagattgcaaccttatgttgctgaactccctgtccatttatgggggaaagatttattacaacagtggcacacaaatatttatataccaacatcagatcaatacagtcatcaaagccaaaaaatgttatggaaacagggttacattcccagattggagttagggtgatatcatcaggggagagtggagcctatcgaacctgagatcaaaatggacagatctggtatgagacactggccttttcattagcggccagtgtaaaataattgtgcatctcctgaacctattggattaaaatggactacagaaaaattggtttgggttgagcagtggcctctttcttcagaaaaatcaaaggttttaaatgaccttgtccaagaacaattagagaagggccatatagaagaatcctttagtccttagaactttccagtgtttgttatacagagaaaaatcaggaaaatggagattcttaacagatttaagaggaataaatgctataattcagcttatgggtgcccttcaaccaggcctcccatctcctagtatgataccagctgactggcccttaattgtcctagacttgaaagactgctttttcacaatccctttacacccagaagatagggaaaaaaattgccttttcagtaccagcaataaacaatatggcccctagaaagccttatcaatggaaggtcctgcctcaaggtatgttaaacagccctaccctgtgtcagtattatgtggcctcagttgttgagccagtccaacgacaattctctaaatactatattgttcattatatggatgacatactttgtactgcaccctcatgggagcagctgactgaggcttttcaatgtctacagtcctgtctgaagggagcaggattgattattgcccctgaaaagattcaagtaaaaagtccatatcaatattttggaactgtggttgaacgtactactgttcgccctcaaaaggtaaaattaagaagagatcaaatttctacattaaatgatttacaaaaactgctaggagacgttaattggctccaaccttttttggggatccctacatgtagattgtcaaatcttttctccttacttagaggagattctaagttaaacagtccccactctctaactgcagaagcaaaccaaaaaagattgaaaataaaatacagaactcccaactgagtcgggtcagctcactgagttagttattatacctacccctcatcctcccaggggaatctcaagtggcttcttcttcccaataatgtcacaaaatctttgtctttgtacctggacctgatggcacagcttattctaaacggtcgtactcgcgatacaaatgtccgggaaagatttgagtcaggtaattgttagtttaactgttaagaaaatccaaaattgttttcaaaactatgtaagatcattagataatcattatccaaaaaaccctattctacaatttgtaaagcaacctcaatgggttcttccaaaaaagttgaagtattcacccatcatagggacccctgtgatctttactgatgggactagtaaagggaaggccggatatgtggctaataaatctaaaactatagagactcctggcctttccacccgacaggccaaactaactgctgtaatccatgccttgagggactatcctgaaccaatcaataccctttccgatttggcatatgtggttcatactgccaaaatgattgagaccgctaccattaaacaaaatttacctgtcttgttatttgacttgtttactgaattgcaaactgttacaagggaaagaagatagccattttatattacctgtatcagagcacatactaacttacctgggcctctaattgcaggaaataaagaaattgaccacttggtggcacccttgttacaagaagctccacattttcacgatttgacacacttgaatgctcgaggccttaaaaagagatttggaataaccgggactaaagccaaaaaaattgtccatcaatgccctgcatgtcagatttttaacaatccttctcaatctgagcctggagttacttctaggggactcatccaaaatgctctctggcaaatggatgttacccattactgtctttggaaaatggtcattcattcaggtgtgtattgacacttgctctaaatgtatttgggctactgctcaatctggtgaatctgctaaacatgttagtcatgatttacatgcctgttttgcagttacgggcctgccgtaggcaatttaaactgataatggtccagcttatatcagttctcaatttaaaatgtttctggacacatggcatgttgctcactccaccggtctcccttacaacccccaaggacaggcaattggagaacaagccaatttatctgtgaagcaggctcttcaaaaacaaaaagggggagacacaggaatacttatgtcacaacacacactttcacttaaaactttattcactctaaattttttatatttggcctcagaagaaaataagattaacttaccccaggctgaacagctcctgattgggtggcaggatccattaacaaacatctggtccccaggaaagcttattacatggggtaggggatatgcttgtatctcgccaggtcactgactacatgtttggattccatcaagaagaatcaaaccatatcatgagtgagcccaggaagcatcccttgactctggaccccaggagaaggatgatgaacaaattaatcataaacttactgatttagaaaatgctgttttggttctgggaggtgaagtccaaaatttgagattacaaagtcagctaaagtgtgattggaatgttacttcttattgtgttactctgtatgaatacaactctagtgaaacatcatgggaacaaattaagaagcatctacaaggtcactcggatgagttgacactggatataaagaaactgcagactagagtcctgagtattcaaaaggcctctctacaaaatatacctcataaagaggtactggataatattctggaagatttaaaaataattatttaaatggtttaaaggttttggtggaggaatgatcagatcactaattgcttttctaggattcttaatgattttctattaagtctgtagatgcatgaagctggcaatccaagacgtaatgacaaagaagttgcaagatctattttcgtcctcctacaaaagcaaaaaggggaacatgttgggagacatgtttctataacttacttagcctctctacttccattttctatgctgaaaagtccatcttgtcttgctttacctccaccctatattcctgcttgagaaacagtcgcagtgctggtaaataatttaagcttaagaacaaagaccaaaaggcataagtcatttacgtggtcagctgaaggaggacaaaatgtgtcagtctaggtatgctggacctgtgcagataggcatgccgtttgcacagcatgatacgtcctgttaagataagaggaagaggagcctcatggttccaaggggtctatgaggagtcgttagcaggataggcatcagcaaggagaacggggtgcaaacctaggcacacctggttgccacagataggcacactgtctgtggaagcacaaaggtggttctctagatgctatgcataaacagctgatgccagccttcctcaatgctaatgattgttaaatgcctaaaggtcagagtaagagttaaccagctatgtgactttaaaacaacaactattctgcacttgcagccccttcctcacttgaagtaatcctaaagaacataataaaaacagtgtggtttcttgaggcagcgctcttgctccataagattttgagtccctcggttcccacctttgattaaattaaatgtctctgtcttattttatgttaatcttttcttcagtttcacagtgcccattcttcagccctcacctgctgagctggtctcagcaagatgggttctaaa

SEQ ID NO: 110 - DNA, 8057 bp, Artificial
  ss940 sequence
tggtgcgttggccgggaagccgacaaccgagctggcctcttgtgccactgttgtcggggaactgggggaggccacagtcgccagcccgttgacaggtggatagcacacactggccattttgccggatccagaccctcactcgggccgtgctggccttggctcacaccgcttcccgaatggactcagaaggagagtggaagcaggttccaggacaggacatcaaactggtgagtgccctggggacatctgcctgagtcaggacccatcatgtggcagaaggagagactgatcacctctcagtgaccaaaagggtcattcaggtcagggtttgctcccttgggatcagaaggcttgtcaattctggtgtgtgtgtgtgtgtgagtgactggagagagcgagagcccgtgctccaccgtctttggactacggagccagagtgagtcctaacctgcagttccgcggcgaccctcacatggcttatggtggccctcttcggggggatcctgacgttggggtttatacagtcccacctatgctaagaggtgcctgaaatatctcctctgggggagcagtcaggaggacgaagtgattgttacctgaggcttgtcctcgctgtttgtcctgcgtcctcggcacagggtgggacttcacacaatgggtaaatcagcttccaagcccactgtcttagagtgtatggttaagaattttaagaaaggattttctagagattatggtgttaaactgagtcctggaaaactgtgtaccctctgtactctggagtggcccccctttggtgctggctggcctccggaagggaccttagatgtgttcacagttgcagcagtatttaatgttataacaggagaccctggacacccagaccaatttccgtatgttgatcaatggctggaaattgcctatttgaggcccccatgggttcggttctgcaccacagaccagggacagtgtagggtgctagtagcccagtccaagaagaaaagcttgtctcaaaaaaaaaaaaaaggtgccacctatttttcaaggggaacctgaggactcaccccctatgccaccacgttatgcgctgccagccccacctctgggagccgaaggtccccagatgccagatagcccacggccttctgtttctcctcctccttctgcttctgaagttcctgaggcaatatcacccctgccaccagattctccagaaccaatgagcaggcgtctccagtcagctcagggagcagccactccagcgttgcaaatgcccttacgggagacacggggaccacagcaagtcacccccgatgggaccatacaagaggggggacatttttattattaccagcccttttccactgccgatctcctcagctggaaacaccatactccctcatattctgaaaagcctcaggcactaattgatctcttagaattcattttccagacacactgtcccacctggatagactgccggcaactcctttttactctgtttgacactaaagagcgctggcgaattgtaacagaagcccaaaaatggattcaggccaatgtggggggtcgagcagacttggcaaactgggtgagggaagccttcccagaagaaaacccccactgggactgtgacaccgaagaagggaaacgtaacctagagaggtaccggcaggtcttcctacagggggcaaaagctggggctaaaaggcctgctaatatagctaagatcagtgagatactacaagagccaaatgaaagcccagccaaattctatgagagactatgtgaggctttccaaatctccaccccttttgatcccgaggcccctgaaaaccaatggataataaatgctgcctttgtgggacaagcccaatcagatatctgtaaaaagctaaagaaattagaaggctttgcaggagagaatgccactaaactgttggaaatagccaacaagttttttattaaccgagaccaggtggctcgccgtgatgcagaaaagagaatgaaacaaaaagtgactcttctggcggccgccctgtcaaaaccggtgcccccagtgggaccaccccataggggacaaggcccaaagccaggagaaaggagtcccctggaacatgaccaatgcgcttactgcaaagaaaagggacattggagaaatgaatgccccaaccatcctgaggaaaagaccaaggccccacctagccggtaccgatctgagccattcagccccaatctgattggcctagctgagtctgattaggggggaccaggctctctccaactgggcccctgagagcctatggtcagaattcaagtagggggccaccccatagactttatggttgacacaagtgccgaactttctatggttacacaacctgtggctcccctctcggggaaagaaaccaccattgttggggccacaggtaaccaaacccacaggcccttctgtggtcctcgatgatgtcgattaggaggccatgaagtaatacatgaatttctttacctgcctgactgcccagtccccctgatgggaagagacctgctggctaaaatgggggcacaaatttccttttctactgatggatcagcccaacttaaattgacagaacccccctctcctttaatcatggctcttgctataaaaaggaaagaggaatggcatttgtactcttccccttcagaaatggggaccattcccccagaactggagactaaatacccattggtttgggctgaagaaaatccaccaggactggcaaaacgccatactcctgtcttgattgatctaaaacccggatctcaactggtaaagctacgacaatactcaattcccagagaagctcgactgggaatccaggttcacctggataggctgcttcagcaccgactgttaataaaatgtcagtccccttggaacacccctttactgcccatgaaaaaaccgggaacacaggactactgcccagttcaggacttgagagccataaatgaagcaacagtcactttacacccatccgtccctaacccatatcccctgctagggctgatcccctgcactgctgagtggtttacttgcctggacttaaaagatgcctttttctgcctccgggtggcacctgccagtcagcccttgtttgcttttgaatgggaaaatccacatacagggacaaaggaacagctcacctggactagactcccacaaggattcaaaaacactcccactctttttagcggcgccttagctgctgtcctggctgaatttcctgggcaaaaactgggctgtgttttgctacagtacattgatgacctcttactagctggcaccatggaggctcagtgcctagagggaacaagagctctcctttccctactgacggaggcagggtatcaggtatcaaagaaaaaggcacaaatctgtaaaaaaacaagtcaagtatctgggctttaacatcatgcagggcccacaaatgctggggactgaaagaaagcaggcagttcgtgccattcctgtccctacgacccgctggaagggtcgtgagttcctaggggcagcaggattctgctggatatggatccctgggttttcagacttggccaggcctctgtaggaggctctaaaagggggaaaaagtctccccttaaatggggaccaagccaggaggcaacatttcagacaatcaaaaccaaactcactgaggctccagccttgggacttcctgatgtaatcagaggatttaacctttttgttcatgaggaaagtgggatggctttgggagtcttaactcaagaatttgggctttggcagaggccggtggcctatatgtccaaacaaattgactcagttgcagccagatggcctccctgtctcagggctggcagctaccaccttgttggtgagagagactgacaagttgactctgggacaaaacctcagtgttaaaatcccacacttggttgtaaccctaatggataccaggggccaccattggctcacacatgcacaaatgactcaatatcaagggttactatgcaaaaatccacgggtaaaactggaggttgtacaaactttgaacccagccacttttctgccagatgaagcagggcccccagaccataactgcttggaggtactagatgaggtgttttccagcaggcctgacttgactgataaaccactccaaaatcctgacctggttttatatactgatggcagcagctctgtggaggatggaaaaaggatggcaggatatgctgtggtatctgacttaaaagtgatggaagcagagatgcttcctcaaagatggtcagcacagagagcagaattatgggccttagtcagaacactggagctcagctgagaccagcaagttaatatttataccgtctcacagtatgcctttacaactttgcatgttcatagagccttatataaagaaagaggactcctcactgctaaaaaaaaaaaaaaaaaaaaaaaaaaaagggattaaaaactaggctgaaatcgtaaagcttctagaggcagtatgggaacctaaagaagttgcagttatccactgtaaaggccaccaaaagggagacgacccagtgacaaaaggaaactgtagtgctgatgcagctgccagacaggcagcccggggacaacagccagacaaacctaaggtctttctggctccagaagtgccagctgtccccagatattctccagaggaagacaaatggataagggaggaaggaggaactaaaactagaatgggatggtgagtcacatgggaccaccgggttggtgttccagaacagctggcctacaaactagtccaccaacaacacgagataacccacatgggcaaaactgccttagagaccctactgggccagtaatatctcattgctcatcttcctgcactctgctcctctgtctcccaaagatgcataacctgtttgcagaataatgcccaccaggggcccaacagaccagctggggcacagcactgcggactgtccccatttgaggatatggaagtggatttcactgaggtcacccctagtaaggggtacaaatgtttactagtttttatctgtactttttcaggatgggtagaagccttccctacctgaactgaaaaggcaagggaagtaaccgaggcactcctgagagacattattcccagatatggaatgcctctgaccattgggtcagataatggactggcatttgtggccaaaacagtaaaacaggtggcaaaatctttacagatccgatggaaactacactctgcttatcaccctcaaagttcagggaaagtagaacgcatgaaccggacccttaaacagacattggcaaagttatgtcaggaaaccggcttgccctgggtagacatgttgccggtggccctcctaaaagtgagatgctccccctgagcgggaataggattctcgccgtttgaaattttatatgggaggccacctccactaatcaatctaaacggaaacaccagggagttgggagacttggaattaaacaaacaattacaaggactggggctcacatttctcggatgcatcaatgggtcacagacagaatacctgtgtccctaggtataacagtacaccctcacaagccaggggaccaggtgtggataaaggactggaaaaaggagtctttgaggccagtatggaagggcctctatactgtaattctaaccacccccactgctcttaaagtaacaggaatagatgcttggatccatcattccagagttaaactggctggcccagctgacgaccatggagaatgggagactgccctcgatccggagagacctctttgcctgataatacggaggaggagacgacgatctcaaagccctgctctgaccacaccggaagctggtcagtcaacgcacgactgaagcttgaggaatcagctgcctgataaaataaactgccttacctaccttccacaagagactttcttactggtatgtactgttgtcttattaccaacatgaatgtttgctgcctgttgctgttaatctggtcccctttggttctgccaggatctatttcctcatgtgacccatgcactcaagtaacccgatcagattaagaggttacatggactttgctttacttcactcatttctcctgttccggagaaattcatggaagttgtactcacaacaggaccacttattctatctgtcaacagagggaccaatatacttgctttgatccacgatactcaccaactgaggaatggttagaagtccagcgccctcataaatcagggcagctaattaatcggacccaaattaccaaccccaagttgccagcatcaatactttttgatgcctgtgaagctataaatgggtcatggacttctactagaccatgtggaagcccgtcatggaaaagagaatataggctctggcataaatatatgtgctggggcaccacctggagcagttgccagaaatgcacttattggaggtgcgtggcctgggcaacctaaaataagggaaacaaaacagctgcccttcaaaagggtacagcccctccagactgtcagactaaagcttgtaacccagttaatttcactattttcaattccagtgagcccaaataaagggagggatttgtggaaaatttaactcaagtaattcctgtctacaaatagatgacaccagaaaggtgatagaagaaattgctgaccgcatgactaaacttgcccatgtgcctgtacaaacttggaaaggatgggatgcagacagtctctttggtaaatggttctcttggttgggaggaattaagacaacagaataatcatagttatacttgcagggtgcctacttgttccctgccttgtacctctcctgataaatattataaaaggttttataaaaaacatggttgaaagaaaaacaacctcccacctgctacttatcagaggctaccaaagggttatgactgatgatgatctctaaagggtgcagatgcacgctgaacatcaagaggggggaatgaaatggagttttaactaaagaacaaccccccttggctaagaaggcagctgcaggcctctccagctatgctcgtcactataccacccttcttgtaataatgcaacaactgtgtgctctctgtccaagccagcagccctgctaatcaggtacccagcattgcttatcagttccacttctgtaaccttgcttgctcagtttcttagggaggaacactgtctgcttggggatggggggaggtcccgatgcttacctgggaaaatcaagaccttgtagtgtataaaatttactgagaacaaagacctggtgctcagactctggcagtgactcctctgatcccgcaccagtgctgaataagccttgcttttccatatctccaagtgctgtttgtctccttccattgccacggtttttgtggtttccacaacagtgcagcggaaacaaatcccactaggaatcatgatgttgcgggttgatctctggccttgctcagtgggttaataatccagtgttgccatgaactgtggtgtaggtctcagatgcagctcagatctggtgttgttgcggctgtggtgtaggctggcatctgtagctctgattagacccctagcctgggagtttccctatgcctacacacaggcacaaggttagatcagaattctttctgctggggccttcaagagcatccagtatgcaccaccaagccacacggggcctggaccagttgccctgggctgtgccctggatgcccagcacccctccatcctggttccacctcgcaaaccccatagacttatctcctgtcactgtcccaacccaggccggaacccagactatcccttcagcatggccacctcagagggtgattgcagtgatgaaatgatgtaccaggacctggatcacagcaagtgcttgaaagacaatagcaaagtgtgatgatgaaactattctgcactcagtccatatggatctggcatctcctgtgtgccgagagctgtccaggccctggggaccagggaggaggatgagctg

SEQ ID NO: 111 - DNA, 8683 bp, Artificial
  ss941 sequence
tgcttctgtaaccttgcttgctcagtttcttagggaggaacactgtctgcttgggggtgggggaggtccgggatgcttacatgggaaaatcaagaccttgtagtgtataaaagttactgagaacaaagacctggtgctcagactctggaggtgactcctctgagcccacaccggtgctgaataaaccttgcttttccatatctctgagtgctgtttgtctccttccgttgccacagtttttgcggtttctacaacattttggtgcattggccgggaagctgacaaccgagctggcctcttgtgccaccgttgtcgaggaaccgggggaggccacggtcgccggcccggtgacaggtggatagcacgcaccggtcatttttgccggatccagaccctcactcgggccgtgctggccttggcccacaccgcttcccgaacggactcaggagagtggaaacaagttcctggacaggacgtcagactggtgagtgccccggggacatctgcccaagtcaggacccaccatacggtggaaggagagactgatcacctctcagtgaccaaagggtcactcaggtcagggtttgctcccttgggatcgggaggcttgtcaattctggtgtgtgtgtgtgtgagtgactggagagaacgagagcccgtgctccacagtccttggactacagcgccagagtgagtcctaacctgcagttccgtggcgacctcatacggcttatggtggccctcttcggggggatcctgacgttggggtttatacagtcccatctatgctaagaggcacctgaaatatctcctccaggggagcggtcaggcagacgaagcgattgttacctgaggccttgccctcactgtttgccttgcgtcaccggcacagggtgggactttacacaatgggtaaatcagcttccaagcccactgtcttagagtgtatggttaagaattttaagaaaggattttctagagattatggtgttaagctgagtcctggaaaactgtgtaccctctgtaccctagagtggccctcttttggtgctggctggcctccagaagggaccttagatgtgttcacagttacagcagtatttaatgttataacaggagaccctggacacccagaccaatttccatatattgatcaatggttagaaattgcctatttgaggcccccatgggttcggttctacaccacagaccagggacagtgtagggtgctagtagcccagtccaagaaaaaaaaccttgtctcaaaaaaaggtgccacctatttatcaaggggaacctgatgactcgccccctatgccaccaccttatgtgctgccggccccacctccaggagccgaaggtccccagatgcctgatagcccaccgccttctgtttctcctcctccttctgcttctgaagttcccaagatgatatcacccccgcagccagattctccagaacctatgagcaggcgtctccgttcagctcagggagcagccactccagcattacaaatgcccttaagggagacacggggaccacagcaagttgcccccgacgggaccataaaagagggggtacgtttttattattaccagcccttttccactgccgatctcctcaactggaaacaccatactccctcattttctgaaaagcctcaggcgctgattgatctcttagaattcattttccagacacactgtcccacctggatagactgccggcaactcctttttactctatttgacactgaagagcgctggcgaattgtaacagaagcccaaaaatggcttcaggccaatgcggggggtcgagcagacttggcaaactgggtgagggaagccttcctagaagaaaacccccactgggactatgacactgagaaagggaaatgtaacctagagaggtactggcaggccttcctacagggggcaaaagctggggctaaaaagcccactaatataactaagatcagtgagatactacaagagccaaatgaaagcccagccaaattctatgagagactatgtgaggctttccgcacctacaccccttttgatcccgaggcccctgagaaccaacagatgataaatgctgcctttgtgggacaagcccaatcagatatctataaaaagctacagatattaaaaggctttgcaggagagaatgccactaaactgttgaaaatagcccacaaggtttttattaaccgaaaccaggtggcccaccgtgatgcagaaaagagaatgaaacaaaaagtgactcttctggcagccgccctgtcaaaaccggtgcccccagtgggaccaccccataggggacaaggcacaaggccagggaaaaggagttccctggaacatgaccaatgtgcttactgcaaaaaaaagggacattggaaaaatgaatgccccaaccgtcctgagaaaaagaccaaggccccacatagccagtaccgatctgagccagccagcaccaacctgatcggcctagctgagtctgattaggggggaccaggctctctccaactgggcccccgagagcctatggtcagaattcaagtagggggccaccccatagactttatggttgacacaggtgccaaactttctgtggttacacaacctgtggctcccctctccgggaaagaaaccaccattgttggggccacaggtaaccaaacccacaggcccttctgcggtcctcaacaatgtcggttaggaggccataaagtaatacatgaatttctttacctgcctgactgcccagtccccctgatgggaagagacctgctgactaaaatggggacacaaatttccttttctactgacggatcggcccaacttaaattgacagaacccccctctcctttaatcatggctcttactgtaaaaagggaagaaaaatggcccttgtactctcccccttcagaaatggggaccattcccccagaactagagactaaatacccattggtttgggctgaaggaaacccaccaggactgacaaaacgccacgctcctgtcttaattgatctaaaacccggagctcaatcagtaaagctacggaaatactcaattcccagagaaactcgactgggaatccaggttcacctggataggctgcttcagcacggactgttaataaaatgtcagtccccttggaacacccctttactgcccgtgaaaaaaccaggaacacaggactaccgccctgtacaggacttgagagccataaataaaacaacagtcacattacacccgtccgtccctaacccatataccctgctagggctgatcccctccactgctgagtggtttacttgcctggacttaaaagacgcttttttctgcctccgggtggcacctgccagtcagcccttgtttgcttttgaatgggaaaatccacatacagggacaaaggaacagctcacctggactagactcccacaagggttcaaaaactctcccactctttttagcggcgccttagctgctgacctggctgaatttcctggacaaaaactgggctgtgttttgctacagtatgttgacgacctcttactagctggcaccacggaggtgcagtgcctagagggaacaagagctctccttcctctactgatggaggcagggtatcaggtatcaaaaaaaagggcacaaatctgcaaaaaacaagtatctgggcttcaacatcatgcagggccaacgaatgctggggactgaaagaaagcaggcagtttgtgccattcctgtccctacccccccaatggttcgtgagttcctaggggcagcaggattctgccggatatggatccccgggttttcagacctggccaggcctctgtatgaggctctaaaaggggaagaaaaggctccccttaaatggggaccaagccaggagacagcgtttcagacaatcaaaactaaactcactgaggctccagccttgggacttcctgatataaccagagaatttagcctttttgttcatgaaaaaaatgggatggctttgggagtcttaactcaagaatttgggccttggcagaggccagtgccatatctgtctaaacaaattgacttagttgctgctggatggcctccctgcctccgagcgctggcagctaccaccttgttggtaagagaggctgacaagttgaccctgggacaaaatctcaatgttaaagtcccacactcagttgtaaccctaatggataccaggggccaccattggctcacacatgcacgaatgactcaatatcaagggttactatgtgaaaatccacgggtaaaactggaggttgtacgaactctgaacccagctacttttctgccagatgaagcggggcccccagaccataactgcctggaggtactagatgaggtgttttccagcaggcctgacttgactgataaaccactccaaaatcctgacctggttttatatactgatggcaacagctttatggaggatggaaaaaggatggcaggatatgctgtggtatctgatttaaaaatgataaaagcagaggtgcttcctcaaggcaggtcagcacaaagaacagaattatgggccttaatcagagcactggaactcagccaagaccagcgagttaatatctataccgactcacgatatgcctttacaactttacatgtccatggagccttatataaagaaagagggctcctcactgctgaaggaaaaaaaattaaaaaccaggctgaaatcttaaaactcctagaggcagtatgagaacctaaagaagttgcagttatccactgtaaaggccaccaaaagggagacgacccagtgacaaaagaaaaccgtagtgctgatgcagctgccagacaggcagctcggggacaacagccagacaaacctaaggtcttgcgggccccagaagtgccagctgtccccaaatattctccagaggaagaaaaatgggtaagggaggaaggaggaactaaaactcaaatggggtggtgggtcacacgggaccaccgagtttacattccagaacagctggcctacaaactagtccgccaagaacatgagctaacccacatgggcaaaactgccttagagaccctactgggccggtactatctcattgctcgtcttcctgcactctgctcctctgtctcccaaagatgcataacctgtttacagaataatgcccgccaggggccccacagaccagctgggacgcagcactgcggactgtccccatttgaggatatggaagtggactttactgaggtcacccctagtaagggggacaaatatttactagtttttatctgtacattttcaggatggatagaggccttccctacccaaactgaaaagacaagggaagtaaccaaggcactcctgagagacattattcccagatatggaatgcctctgaccatcgggtcagataatggaccggcatttgtggccgaaatagtacaacaggtggcaaaagctttacagatccgatggaaactacattctgcgtatcgccctcaaagttcaggaaaagtagaacacatgaactgaacccttaaacagaccctgacaaagttatgtcaggaaactggcttgccctggatagacatgttgccggtggccctcttaaaagtaaaatgctcaccccgagtgggaataggattctcgccatttgaaatcttatatggaaggccacctccactaatcagtttaaaagaaaacaccagggagttgggagactgggaattacacaaacaattacaaggactggggctcactatttctcggatacatagatgggtcacagacagaatacctgtgtccttaggttaaacagtacacccccacaagccgggggaccaggtgtggataaaggacgggaaaaaggagcctttgagaccggtatggaagggcccctatactataattctaaccacccccactgctcttaaagtaacaggaatagatgcttggatccatcattccagagtaaaaccggctggcccagctgacgaccttggagagtgagagactgccctcgatccagagagacctcttcacctgacgacgatcaggtgaggagacgacaatctcaaagccctgctctgaccacaccggaagctggtcagtcaatgcatggctgaagcttgaggaatcagcagcctggtaaaataaactgccttacctcccttccacaagagactctctaactgtcatatactgttatcttatgatcaacatgtatgtttgctgcctgttgctgttaatctggtcccctttggttctgtcaggatccatgtcctcatgtgacccgtgcattcgagtgacccgatcagatcaaggggttacatggactttgctttactccactcatttctcctgttccggagaaattcatggaagttgtactcacaacaagaccacttattctatctgtcagcagggggaccaatatacttgctttgatccacgatactcaccaactgaaaaatggttagaagtccggccttctcataaatcagggcagctaattaatcggacccaaattaccaaccccaagttgccagtgtcaatacttttcaatgcctgtgaagctataaatgggtcatggacttcaactagaccatgtggaagcccataatgagaaagaaaatatagactccaacataaatatatgtgctgggggaccacctggaatgattgcctggaatacacttactggagctgtgtggcctgggcaacctggaataagggagacaaaacagctgtccttcaaaagggtacagcccgtccagactgccagactaaaacttgtaatccagttaatttcactattttcaattccagtgagcccaaatggaaggagagtttcaaaataagcattcgcattgacggaagaggccttgaccctggagctgtgttacatttccagagaatcacgtttgtgctccaagctgcctctcacagcatctttcattccttttataaaaagataaaaaataccccacctcccattccggccacaactaagaacttgttcttagccctggcagaaactattgcacaactctcaaggtctcctcttgttatgtatgcggggaaacaaacacaggagaccactggccttgacaagccagagaactggacccattagagcctcataatgagactacatacccccaactcaccaatggggtatggctcctcaaaactgctattatagggagaaattgtcttgcgaggcagggaggacggtttaatgtttcggtaagaaacttaacatgtttaggcctgaggtattataatctgactgcccaaaagactcaatggtggtcatcctccaatcgctcagagcccaagcctaatcccttgtctaacttttccctccttcgacaagcatgggaagatatcagtactaatatccagtgacgggcaccaaagggattatattggatttgtgaaaaaatggcctattccatactccctcccaaattgggctggggcatgtgtactgggaacaatcagaccttccttcttcctgctcccactgtcactaggagaacaactgggagttcctatatatagggcacagggtgcacagagagaccggaggactctccaaattggagagtgaaaagataatgaatggcccccagaatggataattcaatattatggacctgccacctgggcagaggatggctcttggagatatcacacccctatctatatgctgaaccacatcatcagactacaggcggttttgaaacttataacaaatgacactgcaagggccttgactatattggcccaacaacaaactaaaatgcgcagtgcaacctaccaaaatcgtttggccttggattatttacttacttctgaaagaggggtttgtgaaaaatttaacttaagtaattgctgtctacaaatagatgacaccgaaaaggtggtaaaaaaaaattgctgaccgcatgactaaactagcccatgtacctgtacaaacttggaaaggatgggatgcagacagtctctttggtaaatggttctcttggttgggaggaattaagacaatggtcaaaatagtcatggttatactcacagggtgcctacttgttccctgccttatacctctcctgataaatattataaaaggttttataaaagccatggttaaaaaaaaaaacagcctcccacctgctacttattagaggctaccaaagggttatgactgatgatgatttgtaaagggtgcagatgcaccctgaacatcaaaggggggaatgaaatgaagttttaactaaagaacaaccccaccttggctaagaaggcagctgcaagcctttccagctgtgctcatcactatgccacccttcttgtaataatgtaacaattgtgtgctctctgtccaagccagcagccctgctaattaggtacctagcattgcttatcagttctgcttctgtaaccttgcttgctcagtttcttagggaggaacactgtctgcttggggatgggggaggtccgggatgcttacatgggaaactcaagaccttgtagtgtataaaagttactgagaacaaagacctggtgctcagactctggaggtgactcctctgagcccacaccggtgctgaataaaccttgcttttccatatctccgagtgctgtttgtctcctccgttgcca

SEQ ID NO: 112 - DNA, 8732 bp, Artificial
  ss947 sequence
  misc_feature (1632)..(1731): n is a, c, g, or t
  misc_feature (1735)..(1737): n is a, c, g, or t
tgctcagtttcttagggaggaacactctctgcttggggatggggggaggtctgggatgcttacatgggaaaatcaagaccttgtagtgcataaaagttactgagaacaaagacctggtgctcagactctggaggtgactcctctgagcccgcactggtgctgaataaaccctgcttttccatatctccgagtgctgtttgtctccttccattgccacggtttttgcggtttctgcaacattttggtgcattggctgggaagccgacaaccgagctggcctcttgtgccactgttgtcggggaactgggggaggccacggttgctggcccggtgacaggtggataaaacgcacaccggccattttgccagatccagaccctcactcgggccgtgctggccttggctcacaccacttgctgaagggactcagaaggagcgtggaaacatgttccaggacaggacgtcaaactggtgagtgccccaaggacatctgccagagtcaggacccgtcatatggtggaaggagagattgataacctctcagtgaccaaagaggtcactcaggtcagggtttgctcccttgggatcgggaggcttgtcaattctggtgtgcgtgtgtgagtgactggagagaacaagagcctgtaccccaccgtccttggactacggagccagagtgagtcctaacctgcagttccgtggcgacctcatacggcttatggtggccctcttcggggggatcctgacgttggggtttatacagtcccacctatgctaagaggtgcctgaaatatctcctccaggggagcggtcaggtggacgacgtgattgttacttgaggccttgtcctcgctgtttgtcttgcatcactggcacagggtgggacttcacacaatgggtaaattggcttccaagcccactgtcttagagtgtatggttaagaattttaagaaaagattttctagagattatggtgttaaactgagtcctggaaaactgtgtgccctctgtaccctagagtggccctcctttggtgttggctggcctccggaagggaccttagatgtgttcacagttgcagcagtatataatgttataacaggagaccctggatacccagaccaatttccgtatattgatcaatggttggaaattgcctatttgaggcccccatgggttcggttctgcaccacagaccagggacagtgtagggtgctagtagcccagtccaagaagaaaaccttgtctcaaaaaaaggtgtcacctatttttcaaggggaacctgaggactcgccccctatgccaccaccttatgtgctgccggccccacctctgggagccgaaggtccccagatgccagatagcccaccgccttctgtttctcctccttcttctgcttctgaaattctcaaggcaatgtcacctccacagccagattctccagaaccaatgagcaggtgcctccggtcagctcagggagcagccactccagcattgcgaatgcccttacgggagacatggggaccatggcaagttgcccgcgatgggacatacaaagaggggatgagttttttattacagcccttttcactgctgatctcctcactggaatacatagtcctcatatctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggannngccctattttgaagcctcggcactgattgatctcttagaattcattttccagacacattgtcccacctggatagactgttggcaactcctttttactctgtttgacactgaagagcactggcaaattgtaacagaagcccaaaatggcttcaggccaatgtggggggtcgagcagacttggcaaactgggtaagggaagccttcccagaagaaaacccccactgggactatgacactgaagaagggaaacaacctagagaggtaccggcaggccttcctacagggggcaaaagctggggctaaaaggcctactaatatagctaacaccagtgagatactacaagagccaaatgaaagcccagccaaattctatgagagactatgtgaggctttccgaatctacaccccttttgatccagaggcccctgagaaccaatggatgataaatgctgcctttgtgggacaagcccaatcagacatccgtaaaaagctacagaaattagaaggatttgcaggtaagaatgccactaaactgttggaaatagccaacaaggtttttattaaccgagaccaggtggcccgctgtgatgcagaaaagagaatgaaacaaaaagtaactcttctggcagccaccctgtcaaaacctgtgcccccagtgggaccacccctagggggcaaggcccaaggccagggaaaaggagtcccctggaacatgaccaatgcgcttactgcaaagaaaagggacattggaaaaatgaatgccccaaccgtcctgagaaaaagaccaaggcccacctagccagtaccaatctgagccattcagcaccaacctgatcggcctagctgagtctgattgggggggaccaggctctctccaactgggcccccaaaagcctatggtcagaattcaagtagggagccaccccatagactttatggttgacacaggtgccaaactttctgtggttacacaacctgtagctcccttctcagggaaagaaaccaccatcattggggccacaggtaaccaaacccacaggcccttctgtggtcctcgatgatgttgattaggaggccatgaagtaatacatgaatttctttacctgcctgactgctcagtcctcctgatgggaagagacctgctgactaaaatgggggcacaaatttccttttctactgatggatcggcccaactcaaattgacagaacacacccccccaatcatggctcttgctgtaaaaagagaagaggaatggcgcttgtactcttccccttcagaaatggggaccattccccagaactagagactaaacacccattggtttggactgaaggaaacccaccaggactggcaaaatgccatgctcctatcttgattgatctaaaacccggaactcaaccggtaaagctacgacaatactcaattcccagagaagctcgactgggaatccaggttcacctggataggctgcttcagcaaggactgttaaaaaaatgtcagtccccttggaacacccctttactgcccgtaaaaaaaactgggaacacaagactaccgcccagttgagatccataaatgaagcaacagtcacattacacccgtccgtccctaacccatataccctgctagggccgatcccctccactgctgagtggtttacttgcctggacttaaaagatgcctttttctgcctcagggtggcacccgccagtcagcccttgtttgcttttgaatgggaaaatccacatacagggacaaaggaacagctcacctggactagactcccacaaggattcagaaactctcccactctttttagcggcaccctagccgctgacctggctgaatttcctggacaaaaattgggctgtgttttactacaatatgttgatgacctcttactagctggcaccacggaggctcagtgcctagagggaacaagagctctcctttccctgttgatggaggcagggtatcgggtatcaaaaaaaataaataaataaaaaataaaaggcacaaatctgtaaaaaacaagtcaagtatctgggctttaacatcatgcagggctgacgaaagctggggactgaaagcaggcagtttgtgccattcctgtccccgctggaaagttcgtgagttcctaggggcagcaggattctgccagatatagatccccaggttttcagacttggccaggcctctgtatgaggctctaaaaggggaagaaaaggctccccttgaatagggaccaagccaggaggcagcatttcagacaatcaaaaccaaactcactgaggctccagccttgggacttcctgatgtaaccagagaatttaacctttttgttcatgaaaaaaatgggatggctttaggaggccaatggcatatctgtctaaacaaattgactcagttgcagctggatggcctccctgcctccgagcactggcagctaccaccttgttggtgagagaggctgacaagttgactctgggataaaacctcaatgttaaagtcccgccctcagttgtaaccctgatggataccaggggccaccattggctcacacatgcaggaatgactcaatatcaagggttactatgtgaaaatccacgggtaaaactggaggttgtacgaactctgaacccagccacttttctgccagatgaagcggggcccccagaccataactgcctggaggtactagacgaggtgttttccagcaggcctgacttgactgataaaccactccaaaatcctgacctggctttatatactgatgggagcagctttatggaggatggaaaaacgatggcaggatatgctgtggtatctgacttaaaagtgataaaagcagaggtgcttcctcaaggctggtcagcacagagagcagaattatgggccttaatcagagcactggagctcagcggagaccagcgagttaatatctataccgactcacggtatgcctttgcaactttacatgttcacggagccttatataaaaaaagaggactcctcactgctgaagaaaaagggattaaaaaccaggctaaaatcttaaatctcctagaggcagtatgggaacctaaagaagttgcagttatccactctaaaggccaccaaaagggagacgacccagtgacaaaaggaaactgtagtgctgatgcagctgccagacaggcagcccggggacaacagctagacaaactgaaggtcttgctggccccaaaaatgccagctgtccccaaatattctccagaggaagaaaaatggataagggaggaaggaggaactaaaacaggatggtgggtcacacgggaccactgagtttatgttccagaacagctggcctacaaactagtccaccaacaacacgagctaacccacatgggcaaaactgccttagagaccctactgggccggtactatctcattgctcatcttcctgcactctgttcctctgtctcccaaagatgcataacctgtttgcagaataatgcctgccaggggtccaacagaccagctgcggcacagcactgtggactgtccccatttgaggatatggaagtggacttcactgaggtcacccctagtaaggggtacaaatatttactagtttttatctgtactttttcaggatgggtaaaagcctacccgaactgaaaagacaagggaagtaaccaaggcactcctgagagacattattcccagatatggaatgcctctgaccatcaggtcagataacggacctgcatttgtggccaaaacagtacaacaggtggcaaaagctttacagatccgatggaaactacattctgcttatcgccctcaaagttcagggaaagtagaacgcatgaaccggacccttaaacagacactggcaaagttatgtcaggaaactggcttgctctgggtagacatgttgccggtggccctacgaaaagtgagatgttcacctcgaacaggaatagtattctcgccatttaaaatattataggggaggccactgccactaatcagtttaaaaggaaacaccagggagttgggagacttggaattacacaattacaaggactggggctcactatttctcagatacataaatgggtcacagacagaatacctatgtccttaggtataacagtacacccccacaagccgggggaccaggtgtggataaaggactggaaaaaggagcctttgagaccggtatggaagggcccctatactgtaattctaaccacctccactgctcttaaagtaacaggaatagtggatccatcattccagggttaaaccagccggcccagctgacgaccatggagagtgggagactgccctcgatctggagagacctcttcgcctgacaatatagaggaggagacgacgatctcaaagccctgccctgaccacaccggaagctggtcagtcaatgcatggctgaagtttgaggaatcggctgcttggtaaaataaactgccttacctaccttccacaagagactttcttactgttatatactgtcatcttatgaccaacatgtatgtttgctgcctgttgctgttaatctggtcccctttggttctgcgaggatccatttcctcatgtgacccatgcattcgagtgacccgatcagattaaggggttacatggactttgctttactccactcatttctcctgttctggagaaattcatggaagttgtactcacaacaagaccacttattctatctgtcaacagggggaccaatatacttgctttgatccacgatactcaccaactgaggaatggttagaagtccggtgctctcataaatcagggcagctaattaatcggacctaaattaccagccccaatttgccagtatcaatactttttgatgcctgtgaagctatgaatgggtcatggacttctactagaccatgtggaagcctgtcatgggaaagagaatataggctccagcataaatatatgtgctgggggaccacctggagtggctgccagaaatgcacttactggagctgcatggcctgggcaacctaaaataagggagacaaaacagctgccctttaaaagggtacagctcctccagactgtcagactaaagcttgtaacccagttaatttcactattttcaattccagtgagcccaaatggaaggagggtttcaaaataagcatttgcattgacggaagaggcctagaccctagagctgtgctacatttccagagaatcacgtttgcgctccaagctgcctctcacagggtctttcattccttttatgaagagataaaaaacaccccacctcccattccggccacaactaagaacttgttcttagccctggcagaaactattgcacaaactctcaaggtctcctcttgttatgtatgcaggggaacgaacacaggagaccactggccttggcaagccagagaactgcacccattagagcctcataatgagactgcatacccccaactcaccaatggggtatggctcctcagaactgctatcatagggagaaactgtcttgcaaggcggggaggacggtttaatgtttcagttggaagcctaacatgtttaggcctgaggtattataatctgactgcccaaaagactcaatggtggccatcctccaatctctcagagcccaaacctaatcccctgagcaacttttcccacctccgacaagcatgggaagatatcagtgctaatatccaatggcgggcaccaaagggattacattggatttatggaaaaatggcctattccatacttcccccaaattgggctgggacatgtgtactgggaacaatcagaccttccttcttcctgctcccactatcactaggggaacaactgggagttcctatatatagggcacagggtgcccagagagaccagagggctctccaaattggagactggaaagatgatgaacggcccccagaaagaataattcaatattatgggcctgccacctgggcagaggatggctcttgaggatatcgcacccctatctatatgctgaaccgcatcatcagactacaggcggtttgggaacttataacaaatgacactgcaagggccttgactatattggcccaacaacaaactaaaatgtgcagtgcaatctaccaaaatcgcttggccttggattatttacttgcttctgaaggaggggtttgtggaaaatttaacttaagtaattgctgtctataaatagatgacactgaaaaggtggtaaaagaaattgctgactgcatgactaaacttgcccatgtgcctgtacaaacttggaaaggatgggatacagacagtctctttggtaaatggttctcttggttgggaggaattaagacgatggtcggaataatcatggttatactcgcagggtgcctacttattccctgccttgtacctctcctgataagtattataaaagattttataaaaatcatggttaaaagaaaaacagcctcccacctgctacttatcagaggctaccaaagggttatgactgatgatgatctctaaagggtgcagatgcaccctgaatatcaagagggaggaatgaaacggagttttaactaaagaacaacccccccccccacacacacaccttggctaagaaggcagcccgcaagcctttccagctgtgctcatcactataccacccttcttgtaataatgtaacaactgtgtgccctatgtccaagccagtagccctgttaatcatgtacccagcattgcttatcagttctgcttctgtaaccttgcttgctcagtttcttagggaggaacactctctgcttggggatggggggaggtctgggatgcttacatgggaaaatcaagaccttgtagtgcataaaagttactgagaacaaagacctggtgctcagactctggaggtgactcctctgagcccgcactggtgctgaataaaccctgcttttccatatctccgagtgctgtttgtctccttcca

SEQ ID NO: 113 - DNA, 9243 bp, Artificial
  ss981 sequence
tgtctgcttggggatggggggaggtccgggatgcttacatgggaaaatcaagaccctgtagtgtataaaagttactgagaacaaagacctggtgctcagactctggaggggactcctctgagcccgcaccagtgctgaataaaccttgcttttccctatctccgagtgctgtttgtctccttccattgccacggtttttgcggtttctgcaacatttgtggtgcattggccgggaagccgacaaccgagctggcctcttgtgccactgttgtcagggaaccggggggaagccatggtcgccggcccggtgacaggtggatagcatgcactggccattttgccggatccagaccctcacttgggctgtgctggccttggctcacaccacttcccgaacggactcagaaggagagtgcaaacaggttctaggacaggatgtcagactggcgagttccctggggacatctgcctgagtcaggacctgccatacagtggaaggagagactgatcacctctcagtgaccaaagggtcactcaggtcaggatttgctcccttgggtttgggaggcttgtcaattctggtgtgtgtgtgtgtgtgtgtgtgtgtgagtgactggagagaacgagagcccgtgctccaccgtccttggactacggagccagagtgagtcctaacctgcagttccgcgacgaccctcatatggcttctggtggccctcttcggggggatcctgacgttggggtttatacagtcccacctatgctaagaggtgactgaaatatctcctctgggggagcggtcaggcggacgaagtgattgttacctgaggccttgtcctcgctgtttgtcttgcgtcaccatcacagggtgggacttcacacaatgggtaaattggcttccaagcccaccgtcttagagtgtatggttaagaattttaagaaaggattttctagagattatggtgttaaactgagtcccggaaaactgtgtaccctctgtaccctagagtggccctcctttggtgttggctggcctctggaagggaccttagatgtgttcacagttgcagcagtatataatgttacaacaggagaccctggacacccagacccatttccgtatattgatcaatggttggaaattgcctatttgaggccccatgggttcggttctgccccacagaccagggacagtgtagggtgctagtagcccagtccaagaagaaaaccttgtctcaaaaaaaggtgccacctatttttcaaggggaacctgaggactcgccccctatgccaccaccttatgtgctgccggccccacctctgggagcagagggtccccaggtgccagatagcccaccgccttctgtttctcctcctccttctgcttctgaagttcccgaggcaatatcacccccgcagccacactctccagaacccccgcagccacactctccaggtgtctcaggtcagctcagggagcagccactccagcattgtaaatgcccttacaggagacatggggaccacggcaagtcgccaccgatgggaccatacaagaggggggatggtttttttattaccagcccttttccactgccgatctcctcaactgaaaacaccatactccctcatattctgaaaagcctcaggcgctgactgatctcttagaattcattttccagacacactgtcccacctggatagactgctggcaactcctttttactcagtttgaccctaaagagtactggcaaattgtaacagaagccccaaaatggcttcaggccaatgtggggggtcgagcagacttggcaaactgggtacgggaagccgtcccagaagaaaacccccactgggactatgacactgaagaagggaaacgtaacctagagaggtaccggcaggccttctgacagggggcaaaagctggggcaaaaagcctactaatatagctaagaccagtgagatactacaagagccaaatgaaagcccagccaaattctatgagagactatgtgagcctttccaaatctacaccccttttgatcccgaggcccctgagaaccaacggatgataaatgctgcctttgtgggacaagcccaatcagacatccataaaaagctacagaaattaaaagatttgcaggagaaaatgccactaaactgttggaaatagccaacaagttttttattaactgagaccaggtggcccgccgtgatgcagaaaagagaatgaaacaaaaggtgactcttctggtggccgccctgtcaaaaccggtgcccccagtgggaccaccccataggggacaaggcccaaggccaggaaaaaggagtcccctggaacatgaccaatgcgcttactgcaaagaaaagggacattgaaaaaatgaatacccccaccatcctgagaaaaagaccaaagccccacctagccggtaccgatctgagccattcagcaccaacctgatcagcctagctgagtctgattggggggaccaggctctttccagctgggcccccgagagcctatggtcagaattcaagtaaggggccaccccataaactttatggttgacacaggtgctgaactttctgtggttacacaacctgtagcttcccactcagggaaagaaaccaccatcgttggggccacaggtaaccaaacccacaggcccttctacggtccttgatgatgtcggctaggaggccatgaagtaatacatgaatttctttacctgcctgactgcccaatccccctgatgggaagagacctgctagctaaaatgggggcacaaatttccttttctactgacgtatcagcccaactcaaattgacagaaccccccctctcctttaatcatggctcttgctgtaaaaagggaagagaaatggcacttgtactcttccccttcagaaatggggaccattcccccagaactagagactaaatactcattggtttgggctgaagcaaatccaccaggactggcaaaatgccatgctcctgtcttgattgatctaaaacccggagctcaaccggtaaagctatggcaatactcaattcccagagaagctcgactgggaatccaggttcacctggataggctgcttcagcacggactgttaataaaatgtcagtccccttggaacacccctttactgcccgtgaaaaaaccgggaacacaggactaccacccagttcaggacttgcgagccataaatgaagcaactgtcacattacacccatccgtccctaacccgtataccctgctagggctgatcccctccactgctgagtggtttacttgcctggacttaaaagacgccttcttcggagttcccgtcgtggtgcagtggttaacgaatccgactaagaaccatgaggtttcgggttcggtccctggccttgctcagtgggttaaaggatccagcgttgccgtgagctgtgtggtgtaggttgcagacgcggctcggatcccccattgctgtggctctggcataggctggtggctacagctctgactggacccctagcctgggaacctccatatgccgcaggagcggcccaaaaaatggcaaaaagacaaaaaaaaaaaaaaaagacgcctttttctgcctccgggtggcacctgccagtcagcccttgtttgctcttaaatgggaaaatccacatacagggacaaaggaacagctcacctggactaaactcccacgaggattcaaaaactctcccactctttttagcggcgccctagccactgacctggctgaatttcttggacaaaaactgggctgtgttttactacaatatgttgacaacctcttactagctggcaccacggagttgtttcctctaggctcagtgtctagaggaaacaagagcactcctttccctactgatggaggcagggtatcaggtatcaaagaaaaaggcacaaatctgtaaaaaactagtcaagtatctgggttttaacatcatgcagggctgactaagactagggactaaaagaaagcaggcagtttgtgtcatttctgtccctaccacccaccagaaggtttgtgagttcctagggggcagcaggattctgctggatatggatccccgggttttcagacttggccaggcctcagtatgaggctctaaaaggagaaaaaaaggctccccttgaatggggaccaagccaggagacaacatttcagacaatcaaaaccaaactcactgaggctccagccttgggacttcctgatgtaaccagaaaatttaacctttttgttcatgaaaaaaacgggatggctttgggagtcttaactcaaaaatttgggccttggcagaggccagtggcatatctgcctaaacaaattgactcagttgcagccagatggcctccctgcctcctagcactggcagctaccaccttgttggtgagagaggctgccaagttgactctgggacaaaacctcagtgttaaaatcctgcactcagttgtaaccctaatggataccaggggccgccattggctcacacatgcacaaatgactcaatatcaagggttactatgtgaaaatccacgggtaaaactggaggttgtacgaactctgaatccagccacttttctgccagatgaagcggggccccccagaccataactgcttggaggtactagatgaggtgttttccagcaggcctgacttgactgataaaccactccaaaatcctgacctggttttatatactgatggcagcagctttatggaggatgggaaaaggatgatatctgacttaaaagtgataaaaacagaagtgcttcctcaaggatggtcaacacagagagcagaattatgggccttaatcagagcactggagcttagccgagaccggcgagttaatatctataccaactcatggtatgcctttgcaactttacatgttcatggagccttatataaaaaaagaggactcctcactgctaaagaaaaagggattaaaaaaccaggctgaaatcttaaagctcctagatgcagtatgggaacctaaagaagttgcagttatccactgtaaaggccaccaaaagggagacgacccagtgacaaaaggaaaccgtagtgctgatgcagctgccagacaggcagcccggggacaacagccagacaaacctaaggtcttgctggctccagaagtgccagctgtccccagatattctccagaaaaaaaaataaataaataaataagaaaaaaaggagaaactaaaactaagatgggatggtgggtcacacaggaccaccaagcttatgttccagaacagctggcctacaaactagtccaccaataacacgagctaacccacatgggcaaaactgccttagagaccctactgggctggtactatctcattgctcgtcttcctgcactctgctcctctgtctcccaaagatgtataacctgtttgcagaataatgcccgctgggacacaacactgtggactgtccccattgaggatatggaagtggacttcactaaggtcacccttagtaaggggtacaaatatttactagtttttatctgtactttttcaggatgggtaaaagccttccttacccgaactgaaaaggcaaggaaagtaaccaaggcactcctgagagacattattcccagatatggaatgcctctgaccatctggtcagataacggactggcatttgtggccaaaacagtaaaacaggtggcaaaagctttacagatccgatggaaactatcgccctcaaagttcggggaaagtagaacacatgaaccggacccttaaacagacactggcaaagttatgtcaggacactggcttgccctgggtagacatgttgccagtggccctcctaaaagtgagatgttcaccccgagcaggaataggattctcaccatttgaaatcttatatgggaggccacctccactaatcagtttaaaagcaaacacccgggagttgggagacttggaattacataaacaattacaaggactggggctcactatttctcagatacataaatgggtcgcagacagaatacctgtgtccttaggtataacagtacacccccaaaagccgggggaccaggtgtagataaaggactggaaaaagaagcctttgaggccagtatggaagggcccctatactgtaattctaaccacccccactgctcttaaagtaacaggaatagatgcttggatccatctttccagagttaaaccgtctggcccagctgatgactgtggagagtgggagactgcctttgatccggagagacctcttcgcctgacaatacagagaaggagacgacgatctcaaagccctgccctgaccacactggaagctggtcagtcaatgcacagctgaagcttgaggaaacggttgcctggtaaaataaactgccttacctcccttccacaagagactttcttactgttatatactgttatcttatgagcaacatgtatgtttgctgcctgttgctgttaatctggtcccctttggttctgccaggatccatttcctcatgtgacccatgcattcgagtgacccaatcagatcaaggggttacatggactttgctttactccactcatttctcctgttccggagaaattcatggaagttgtactcacaacaggaccacttattctgtcaacagggggaccaatatacttgctttgatccacaatactccccaactgagaaatggttaaaagtctggcactcttataaatcagggaagctaattaatctgacccaaattaccaaccccaagttgccagtatcaatactttttgatacctgtgaagctatgaatgggtcatggacttctactagaccatgtgaaagcccgtcatgggaaagagaatacaggctccagcataaatatatgtgctggggggccacctggagtgattgccagaaatacacttactggagctgcatggcctggacaacctaaaataagggagacaaaacagctgcccttcaaaagggtacagcccctccagactgtcagactaaagcttgtaacccagttaatgtcactattttctttttttttgtcttttgtctttttgtctttttatcgttgttgttgttgctatttcttgggccgctcccgcagcatatggaggttcccaggctaggggttgaatcggagctgtagccaccggcctatgccagagccacagcaacgcgggatccgagccgcgtctgcaacctacaccacggctcacggcaacgccggatcattaacccactgagcaagggcagggaccgaacccgcaacctcatggttcctagtcggattcgttaaccactgcgccacgacgggaactccaatgtcactattttcaattccagtgagcccaaatggaaggagcgtttcaaaataagcattcgcattgacggaagaggccttgaccctggagctgtgctacatttccagagaatcacgtttgcactccaagctgcctcttacaggggctttcattccttttatgaagagataaaaaacaccccacctcccattctggccacaactaagaacttgttcttagccctggcagaaactattgcacaaactctcaaggtctcctcttgctacatatgcgggggaataaacacaggagaccactgtccttggcaagccagagaactggacccattagagcctcataatgagactgcatacccccaactcaccgatggggtatggctcctcagaactgctattatagggagaaattgtcttgcgaggcggggaggacgatttaatgtttcagttggaagcctaacatgtttaggcctaaggtattataatctgactgcccaaaagactcaatggtggtcatcctccaatcgctcagagcccaagcctaatcccttgtctaacttttccctccttcgacaagcatgggaagacatcagtactaatatccaaaggcgggcaccaaagggattatattggatttgtgaaaaaatggcctattccatactcccccccaattgggctggggcatatgtactgggaacaatcagaccttccttcttcctgctcccactatcactaggggaaaaactgggagttcctatatatagggcacagggtgcccagagagaccggagggctctccaaattggagactggaaagatgataaaatggcccccagaaaaaataattcaatattatgggcctgccacctgagcagaggatggctcttggggatctcacacccctgcctatatgctgaagtgcattatcagactacaggaggttttggaacttataacaaatgacactgcaaggccttgactatattggcccaacaacaaactaaaatgtgcagtgcaatctaccaaaatcgcttggccttggattatttacttgcttctaaaggaggggtttgtggaaaatttaacttaagtaattgctgtctacaaatagatgacaacggaaaggtggtagaagaaattgctgacctcatgactaaacttgcccatgtacctgtacaaacttggaaaggatgggatgcagacagtctctttggtaaatggttctcttggttgggaggaattaagataatggtcggaataatcatggttatactcgcagggtgcctacttgttccctgccttgtacctctcctgataaatattataaaaggttttataaaaaccatggttaaaaaaaaacaaacctcccacctgctacttatcagaggctaccaaagggttatgactgataatgatctttaaagggtgcagatgcaccctaaacatcaagagggggtaatgaaatggagttttaactaaagaacaacccccccttggctaagaaggcagctgcaagcctttccagctatgctcgtcactacaccacccttctggtaataatgtaacaacggtgtgacctctgtccaagccagcagccctgctaatcatgtacccagcattgcttatcagttccgcttctgtaaccttgcttgctcagttccttagggaggaacactgtctgctcggggatgggggaggtccgggatgcttacataggaaaatcaagaccttgtagtgtataaaagttactgagaacaaagacctggtgctcagactctggaggggacttctgagcccgcaccggtgctgaataaaccttgcttttccctatctccgagtgctgtttgtctccttccattgccacggtttttgcggtttccgca

SEQ ID NO: 114 - DNA, 7932 bp, Artificial
  ss874 sequence
tgtgtgctctctgtccaagccagcagccctgctaatcatgtacccagcattgcttatcagttctgcttctgtaaccttgcttgctcagtttcttagggaggaacactgtctgcttggggatgggggaggtccaggatgcttacatgggaaaatcaagaccctgtagtgtataaaagtgactgagaacaaagacctggtgctcagactctggaggggactcctctgagcctgcactggtgctgaataaaccttgcttttccatatctccgagtgctgtttgtctccttctgttgccacagtttttgcggtttccgcaacattttggtgcattggccgggaagccgacaaccgagctggcctcttgtgccatcgttgtcggggaaccgggggaggccacggtcgccggcccggtgacaggtggatagcgcgcaccggccattttgccggatccagaccctcactcgggccgtggccttggcccacaccgcttcccgaacggactcagaaggagaatggaaataggttccaggacaggacgtcggactggtgagtgccccggggacatctgcccaagtcaggacccgccatacggcagaaggagagactgattacctctcagtgaccaaagggtcacttgggtcagggtttgctcccttgggatcaggaggcttgtcaattctggtgtgcgtgtgtgtgtgtgagtgactggagagaacgagagcccatgctccaccgtctttggactatggagccagagtgagtcctaacctgcagttccacggcgaccctcatacggcttctggtggccctcttcggggggatcctgacgttggggtttatacagtcccacctatgctaagaggcgcctgaaatatctcctccgggggagcggtcaggcagacgaagcgattgttacctgaggccttgccctcactctttgtcatgtgtcgcaggcacagggtgggacttcacacaatgagtaaatcggcttccaggcctactgtcttagagtatatggttaagaattttaagaaaggattttctagagattatggtgttaagctgagtcctggaaaactgtgtaccctctgtaccctagactggccctcctttggtgctggctggcctccagaagggaccttagatgtgttcacagttgcagcagtataacaggagaccctggacacccagacccatttccgtatattgatcaatggttggaaattgtctatttgaggcccccaaggttcggttctgcaccactgaccaggaccgtagggtgctagtagcccagtccaagaagaaaaccttgcctcaaaagaaagtgccacctatttatcaaggggaacctgaggactcgccccctatgccaccaccttatgtgctgccggccccacctccaggagccaaaggtacccagatgccagatagcctaccgccttctgtttctcctccttcttctgcttctgaagttcccgaggcaatatcacccccgcagccagattctccagaacctatgagcaggcgtctctgttcagctcagggagcagccactccagcattacaaatgcccttacgggagacacggggaccacagcaagtcgcccccgatgggaccatacaagaggggggacgtttttattattaccagcccttttccactgccgatctcctcaactggaaacaccatactccctcatattctgaaaagcctcaggcgctgattgacctcttacaattcattttccagacacactgtcccacctggatagactgccggcaactcctttttactctatttgacactgaagagcgctggcgaattgtaacagaagcccaaaaatggcttcaggccaatgcagggggtcgagcagacttggcaaactgggtgagggaagccttcccagaagaaaacccccactgggactatgacactgaagaagggaaacgtaacctagagaggtactggcaggccttcctacagggggcaaaagctggggctaaaaggcctactaacatagctaagatcagtgagatactacaagagccgaatgaaagcccagccaaattctatgagacactatgtgaggctttccgaacctacaccccttttgatccctaggctcctgagaaccaacggatgataaatgctgcctttgtgggacaagcccaatcagatatccgtaaaaagctacagaaattagaaggctttgcaggagagaatgccactaaactgttggaaatagccaacaaggttttattaaccgagaccaggtggcccgccatgatgcagaaaagagaatgaaacaaaaagtgactcttctggcggccgccctgtcaaaaccggtgcccccagtggggccaccccgtaggggacaaggcacaaggccagggaaaaggagtcccctggaacatgaccaatgtgcttactgcaaagaaaagggacattggaaaaatgaatgccccaaccatcctgagaaaaagaccaaggcaccacctagccggtaccgatctgagccactcagcaccaacatgatcggcctagctgagtctgattggggggaccaggctctctccaactgggcccccgagagcctatggtcagaattcaagtagggggccaccccatggactttatggttgacacaggtgccgaactttctgtggttacacaacctgtggctcccctctcagggaaagaaaccaccattgttggggccacaggtaaccaaacccacaggcccctctgcggtcctcgacgatgtcggttaggaggccatgaagtaatacatgaatttctttacctaactgactgcccagtccccttgatgcgaagagacctgctggctaaaatgggggcaccaatttccttttctactgatggattggcccaacttaaattgacagaacccccctctcctttaatcatggctcttgctgtaaaaagagaagaggaatggcgcttgcactcttccccttcagaaatggggaccattcctccagaactagagactaaatacccattggtttgggctgaaggaaacccaccaggactggcaaaacgccacactcctgtcttgattgatctaaaacccggagctcaaccggtaaagctatggcaatactcaattcccagagaagctcgactgggaatccaggttcacctggataggctgcttcagcacggactgttaataaaatgtcagtccccttggaacacccctttactgcccgtgaaaaaaccgggaacacaggactaccgcccagtacaggacttgagagccataaatgaagcaacagtcacattacactcgtccatccctaacccgtgtaccctgctagggctgatcccctccactgctgagtggtttacttgcctggacttaaaagacgcctttttctgcctctgggtggcacctgctagtcagcccttgtttgcttttgaatgggagaatccacatacagggacaaaggaacagctcacctggactagactcccacaaggattcaaaaactctcactctttttagcggcgccttagctgctgacctggctgaatttcctggacaaaaactgggctgtgttttgctacagtatattgacaacctcttactagctggcaccacggaggctcagtgcctagagggaacaagagctctcctttccctactgatggaggcagggtatcgggtatccaagaaaaaggcacaaatctgcaaaaaacaagtcaagtatctgggcttcaacatcacgcagggccgacgaatgctggggactgaaagaaagcaggcagtttgtgccattcctgtccctaccatccgctggaaggttcctgagttcctaggggcagcaggattctgccggatatggatgcccgggttttcagacctggccaggcctcagtatgaggctctaaaaggggaagaaaaggctccccttaaatggggaccaagccaggagacagcgtttcagacaatcaaaaccaaactcactgaggctccagccttgggacttcctgatgtaaccagagaatttaacctttttgttcatgagaaaaatgggatggctttgggagtcttaactcaagaatttgggccatggcagaggccagtggcctatctgtctaaacaaattgactcagttgctgccagatggcctccttgcctccaagcactggcagctaccaccttgttggtgagagaggctgacaagttgaccctgggacaaaacctcaatgttaaagtcccacactcagttgtaaccctaatggataccaggggccaccattggctcacacatgcacgaatgactcaatatcaagggttactatgtgaaaatccacgggtaaaagtggaggttgtacaaactctgaacccagctacttttccgccagatgaagcggggcccccagaccgtaactgcctggaggtaccagatgaggtgttttccagcagcactgacttgactgataaaccactccaaaatcctgacctggttttatatactgatggcagcagctttatggaggatggaaaaaggatggcaggatatgctgtggtatctgacttaaaagtgatagaagcagacgtgcttcctcaaggctggtcagcatagagagcagaattatgggccttaatcagagcactggaactcagccaagaccagcgagttaatatcttaccgactcacgatatgcctttgcaactttacatgtccatggagccttatctaaagaaagagggctcctcactgctgaaggaaaaggaattaaaaaccaggctgaaatcttaaagctcctagaggcagtatgggaacctaaagaagctgcagttacccactgtaaaggccaccaaaagggggatgacccagtgacaaaaggaaaccgtagtgctgatgcagctgccagacaggcagcctggggacaacagccagacaaacctaaggtcttgctggccccagaagtgccagctgtccccaaatattctccagaggaagaaaaatggataagggaggaaggaggaactaaaactaaaacggggtggtgggtcacacgggaccactgagtttacattccagaacagctggcctacaaactagtccgccaagaacatgagctaacccacataggcaaaactgcattagagaccctactgggccggtactatctcattgctcgtcttcctgcactctgctcctctgtctcccaaagatgcataacctgtttacagaataatgcccaccaggggccccacagaccagctggggcatagcactgtggactgtccccatttgaggatatggaagtggactttactgaggtcacccctagtaaggggtacaaatatttactagtttttatctgtactttttcaggatgggtagaggccttccctacccagactgaaaagacaaggaaagtaaccaaggcactcctgagagatatcattcccagatatggaatgcctctgactattgggtcagataatggaccagcatttctggccaaaacagtacaacaggtgacaaaagctttacagatccgatggaaactacattctgcttatcaccctcaaagttcagggaaagtaaaacgcatgaactgaacgcttaaacagaccctggcaaagttatgtcaggaaactggcttgccctggaagacattttgccggtggccctcttaaaagtgagatgctcaccccaagtgggaataggattctcgccatttgaagtcttatatggaaggccaccttcaccaatcagtttaaaaggaaacaccagggagttgggagacttggaattacataaacaattacaaggactggggctatttctcagatacataaatgggtcacagacagaatacctgtgtccttaggtataacagtacacccccacaagccgggggaccaggtgtggataaaggactggaaaaaggagcccttgaggccagtatggaagggcccctatactgtaattctaaccacccccaccactcttaaagtaacaggaatagatgcttggatccatcattccagagtaaaaccagctggcccagctgacaaccgtggagagtgggagactgccctcgatccggagagacctcttcgcctgacaatacagaggaggagacgacgacgatctcaaagccctgctctgaccacaccggaagctggtcagtcaacgcacggctgaagcttgaggaattggctgcctgtgagcccaaatggaaggagggtttcaaaataagcattcgcattgatggaggaggcctgtactacatttccagagaatcatgtttgcactccaagctgcctctcacagcgtctttcattccttttataaagagataaacaccccacttcccattccggccataactaagaacttgttcttagccctggcagaaactattgcacaaactctcaaggtctcctcttgttatgtatgcgggggaacgaacacaggagaccactggccttggaaagccagagaactggacccattagagcctcataatgagactgcatacccccaactcaccgatggggtatggctcctcagaactgctattatagggagaaattgtcttgcgaggcggggaggacggtttaatgtttcagttggaagcctaacatgtttaggcctaaggtattataatctgactgcccaaaagactcaatggtggtcatcctccaatcgctcagagcccaagcctaatcccttgtctaacttttccctccttcgacaagcatgggaagacatcagtactaatatccaaaggcgggcaccaaagggattatattggatttgtggggaaaatggcccattccatactcccctccccaaattgggctggggcatgtgtactgggaacaatcagaccttccttcttcctgatcccactgtcactaggggagcaactgggagttcctatatatagggcacagggtgcccagagagactggagggctcccaaattagagactggaaagatgatgaatggcccccagaatggataattcaatattatggacctgccacctgggcagaggatggctcttggggatatcgcacccctatctatatgctgaaccgcatcatcagactacaggtggttttggaacttataacaaatgacactgcaagggccttcactatattggcccaacaacaaactaaatgcgcagtgcaatctaccaaaatcgcttggccttggattatttacttgcttctgaaggaggggtttgtggaaaatttaacttaagtaattgctgtctacaaatagatgacaccggaaaggtggtagaagaaattgctgaccgcatgactaaaccagcccatgtacctgtacaaacttggaaaggatgggatgcagacagtctctttggtaaatggttctcttggttgggaggaattaagacaatagtcggaatagtcatggttatactcgcagggtgcctacttgttccctgccttgtacctctcctgataaatatcataaaaggttttataaaaaccatggttgaaagaaaaacagcctcccacctgctacttattagaggctaccaaagggttatgactcatgatgatctgtaaagggtgcagatgcaccctgaacatcaagaggggggaatgaaatggagttttaactaaagaacaacccccccttggctaagaaggcagctgcaagcctttccagctgtgctcatcactatgccacccttcttgtaataatgtaacaactgtgtgctctctgtccaagccagcagccctgctaatcatgtacccaacattgcttatcagttccgcttctgtaaccttgcttgctcagtttcttagggaggaacactgtctgcttggggatggggggaggtccgggatgcttacatgggaaagtcaagaccctgtagtgtataaaagtgactgagaaca

SEQ ID NO: 115 - DNA, 7525 bp, Artificial
  ss881 sequence
  misc_feature (1979)..(2078): n is a, c, g, or t
tgccacaaaatgttgaaaatcctgataaatatatcttggtgacaatatgtctcccccacccagagacaggcacaaacatgtaactccagaacaacttaaaattaattggtccacaaagcgcgggctctcgaagttttgaattgactggtttgcgatattttaaaaatgattagtttgtaaaagcgcgggctttgttgtgaaccccataaaagctgtcccgactccacactcggggccgcagtcctctacccctgcgtggcgtacgactgtgggccccagcgcgctcggaataaaaatcctcttgctgtttgcatcaagaccgcttctcgtgagtgatttggggtgtcgcctcttccgagtcaggacgagagggattttaactcgactggcctttcagtttggtgcattggccgggaaacccgcgactacccctcacacccgagaaccgacttggaggtaaagggatcccctttggaacgtgtgagtgtgtgtgtcggctggcgtctctgttctgagtgtctgttttcggtgatgcgcgctttcggtttgcagctgtcctctcagaccgtaaggactgggggactgtgatcagcagacgtgctaggaggatcacaggctgccaccctgggggacgccccgggaggtggggagagccagggacgcctggtggtctccttctgtcggtcagaggaccgagttctgttgttgaagcgaaagcttccccctccgcggccgtccgactcttttgcctgcttgtggaagacgcggacgggtcgcgtgtgtctggatctgttggtttctgttttgtgtgtctttgtcttgtgcgtccttgtctacagttttaatatgggacagacggtgacgacccctcttagtttgactctcgaccattggactgaagttaaatccagggctcataatttgtcagttcaggttaagaagggaccttggcagactttctgtgtctctgaatggccgacattcgatgttggatggccatcagaggggacctttaattctgagattatcctggctgttaaagcaattatttttcagactggacccggctctcatcccgatcaggagccctatatccttacgtggcaagatttggcagaggatcctccgccatgggttaaaccttggctgaataagccaagaaagccaggtccccgaattctggctcttggagagaaaaacaaacactcggctgaaaaagtcaagccctctcctcatatctaccccgagattgaggagccgccggcttggccggaaccccaatctgttcccccacccccttatccggcacagggtgctgcgaggggaccctctgcccctcctggagctccggcggtggagggacctgctgcagggactcggagccggaggggcgccaccccggagcggacagacgagatcgcgacattaccgctgcgcacgtacggccctcccataccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaacttggctaagggtagagaggtgatgcagggaccggatgaaccttcctcagttttcttgagagctcatggagccttcaggcgtcacccctttgatcctactcggagctcaaaagctcagtgctctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccatctaggaaactaaaagataaaaaatcctgggtgatgggtgccacagggcaacaacaatatccatggactacccgaagaacagttgacttgggagtgggacgggtaacccactcgtttctggtcatacctgagtgcccagcacccctcttaggtagagacttactgaccaagatgggagcacaaatttcttttgaacaagggaaaccagaagtgtctgcaaataacaaacctatcactgtgttgaccctccaattagatgacgaatatcgactatattctcccctagtaaagcctgatcaaaatatacaattctggttggaacagtttccccaagcctgggcagaaaccgcagggatgggtttggcaaagcaagttcccccacaggttattcaactgaaagccagtgctgcaccagtgtcagtcagacagtaccccttgagtaaagaagctcgagaaggaattcggccgcatgttcaaagattaatccaacagggcatcctagttcctgtccaatctccctggaatactcccctgctaccggttagaaagcctgggactaatgactatcgaccagtacaggacttgagagaggtcaataaacgggtgcaggatatacacccaacagtcccgaacccttataacctcttgtgtgctctcccaccccaacggagctggtatacagtattggacttaaaggatgccttcttctgcctgagactacatcccactagccaaccactttttgccttcgaatggagagatccaggtgcgggaagaaccgggcagctcacttggactcgactgccccaagggttcaaaaactccccgaccatctttgacgaagccctacacagagacctggccaacttcaggatccaacacccccaggtgaccctcctccagtacgtggatgacctgcttctggcgggagccaccaaacaggactgcttagaaggtacgaaggcactactgctggaattgtctgacctaggctacagagcctccgctaagaaggcccagatttgcaggagagaggtaacatacttggggtacagtttgcggggcgggcagcgatggctgacggaggcacggaagagaactgtagtccagataccggccccaaccacagccaaacaagtgagagagtttttggggacagctggattttgcagactgtggatcccggggtttgcgaccttagcagccccactctacccactaaccaaagaaaaaggggaattctcctgggctcctgagcaccagaaggcatttgatgctatcaaaaaggccctgctgagcgcacctgctctggccctccctgacgtgactaaaccctttaccctttatgtggatgagcgtaagggagtagcccggggagttttaacccaaactctaggaccatggaggagacctgttgcctacctgtcaaagaagctcgatcctgtagccagtggttggcccgtatgcctgaaggctatcgcagctgtggccatactggtcaaggacgctgacaaattgactttgggacagaatataactgtaatagccccccatgcgttggagaacatcgttcggcagcccccagaccgatggatgaccaacgcccgcatgacccactatcaaagcctgcttctcacagagagggtcacgttcgctccaccagccgctctcaaccctgccactcttctgcctgaagagactgatgaaccagtgactcatgattgccatcaactattgattgaggagactggggtccgcaaggaccttacagacataccgctgactggagaagtgttaacctggttcactgacggaagcagctatgtggtggaaggtaagaggatggctggggcggcggtggtggacgggacccgcacgatctgggccagcagcctgccggaaggaacttcagcacaaaaggctgagctcatggccctcacgcaagctttgcggctggccgaagggaaatccataaacatttatacagacagcaggtatgcctttgcgactgcacacgtacacggggccatctataagcaaagggggttgcttacctcagcagggagggaaataaagaacaaagaggaaattctaagcctattagaagccttacatttgccaaaaaggctagctattatacactgtcctggacatcagaaagccaaagatcccatatccagagggaaccagatggctgaccgggttgccaagcaggcagcccagggtgttaaccttctgcctatgatagaaacacccaaagccccagaacccggatgacagtacaccctagaagactggcaagaaataaaaaagatagaccagttctctgaaactccggaggggacctgctatacctcagatgggaaggaaatcctgccctttgtgctttttagggtgaggaacacccctggacagtttgggctgaccccctatgaattgctctacgggggaccccccccgttggcagaaattgcctttgcacatagtgctgatgtgctgctttcccagcctttgttctctaggctcaaggcgctcgagtgggtgaggcagcgagcgtggaagcagctccgggaggcctactcaggaggagacttgcaagttccacatcgcttccaagttggagattcagtctatgttagacgccaccgtgcaggaaacctcgagactcggtggaagggaccttatctcgtacttttgaccacaccaacggctgtgaaagtcgaaggaatccccacctggatccatgcatcccacgttaagccggcgccacctcccgattcggggtggaaagccgaaaagactgaaaatccccttaagcttcgcctccatcgcgtggttccttactctgtcaataactcctcaagttaatggtaaacgccttgtggacagcccgaactcccataaacccttatctctcacctggttacttactgactccggtacaggtattaatattaacagcactcaaggggaggctcccttggggacctggtggcctgaattatatgtctgccttcgatcagtaatccctggtctcaatgaccaggccacaccccccgatgtactccgtgcttacgggttttacgtttgcccaggacccccaaataatgaagaatattgtggaaatcctcaggatttcttttgcaagcaatggagctgcgtaacttctaatgatgggaattggaaatggccagtctctcagcaagacagagtaagttactcttttgttaacaatcctaccagttataatcaatttaattatggccatgggagatggaaagattggcaacagcgggtacaaaaagatgtacgaaataagcaaataagctgtcattcgttagacctagattacttaaaaataagtttcactgaaaaaggaaaacaagaaaatattcaaaagtgggtaaatggtatgtcttggggaatagtgtactatggaggctctgggagaaagaaaggatctgttctgactattcgcctcagaatagaaactcagatggaacctccggttgctataggaccaaataagggtttggccgaacaaggacctccaatccaagaacagaggccatctcctaacccctctgattacaatacaacctctggatcagtccccactgagcctaacatcactattaaaacaggggcgaaactttttaacctcatccagggagcttttcaagctcttaactccacgactccagaggctacctcttcttgttggctttgcttagcttcgggcccaccttactatgagggaatggctagaggagggaaattcaatgtgacaaaggaacatagagaccaatgtacatggggatcccaaaataagcttacccttactgaggtttctggaaaaggcacctgcatagggatggttcccccatcccaccaacacctttgtaaccacactgaagcctttaatcgaacctctgagagtcagtatctggtacctggttatgacaggtggtgggcatgtaatactggattaaccccttgtgtttccaccttggttttcaaccaaactaaagacttttgcgttatggtccaaattgtcccccgggtgtactactatcccgaaaaagcagtccttgatgaatatgactatagatataatcggccaaaaagagagcccatatccctgacactagctgtaatgctcggattgggagtggctgcaggcgtgggaacaggaacggctgccctaatcacaggaccgcaacagctggagaaaggacttagtaacctacatcgaattgtaacggaagatctccaagccctagaaaaatctgtcagtaacctggaggaatccctaacctccttatctgaagtggttctacagaacagaagggggttagatctgttatttctaaaagaaggagggttatgtgtagccttaaaagaggaatgctgcttttatgtggatcattcaggagctatcagggactccatgagcaagctcagagaaaggttagaaaaacgtcacaaagaaaaagaggctggccaaggatggtttgagggatggttcaacaagtccccatgggtgaccaccctgctttctgctctaacaggacccctagtaatactgctcctgttgcttacagttgggccttgcttaattaatcggtttgttgcctttgttagagaacaagtgagtgcagttcggatcatggtacttagacagcagtaccaaggccttccaagctaaggagaaactgacctttagccttcctagttctaagattagaactattaacaagagaagaagtggggaatgaaaggatgaaaatgcaacctgactctcccagaacccaggaagttaataagaagctctaaatgccctcgaattccagaccctgttccctataggtaaaagatcatactttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcataagataaaaagaggagaagtcaattgcctaacggaccccagtaagatcgggcgtgccacaaaatgttgaaaatcctgataaatatatcttggtgacaatatgtctcccccacccagagacaggcacaaacatgtaactccagaacaacttaaaattaattggtccacaaagcgcgggctctcgaagttttgaattgactggtttgcgatattttaaaaatgattagtttgtaaaagcgcgggctttgttgtgaaccccataaaagctgtcccgactccacactcggggccgcagtcctctacccctgcgtggcgtacgactgtgggccccagcgcgctcggaataaaatcctcttgctgtttgcatcaagaccgcttctcgtgagtgatttggggtgtcgcctcttccgagtca

SEQ ID NO: 116 - DNA, 8551 bp, Artificial
  ss1006 sequence
tgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgacagccctagtgacctatctcaactgcaatctgtcactctgcccaggagcccacgcagatgcggacctccggagctattttaaaatgattggtccacggagcgcgggctctcgatattttaaaatgattggtccacggagcgcgggctctcgatattttaaaatgattggtttgtgacgcacaggctttgttgtgaaccccataaaagctgtcccgattccgcactcggggccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgagggggattgttcttttactggcctttcatttggtgcgttggccgggaaatcctgcgaccaccccttacacccgagaaccgacttggaagtaaagggatcccctttggaacgtgtgtgtgtgtcggccggcgtctctgttctgagtgtctgttttcggtgatgcgcgctttcggtttgcagctgtcctctcagaccgtaaggactggaggactgtgatcagcagacgtgctaggaggatcacaggctgccaccctgggggacgccccgggaggtggggagagccagggatgcctggtggtctcctactgtcagtcagaggaccgagttctgttgttgaagcgaaagcttccccctccgcggccgtccgactcttttgcctgcttgtggaagacgcggacgggtcgcgtgtgtctggatctgttggtttctgtttcgtgtgtctttgtcttgtgcgtccttgtctacagttttaatatgggacagacagtgacgaacccccttagtttgactctcgaccattggactgaagttagatccagggctcataatttgtcagttcaggttaagaagggaccttggcagactttctgtgcctctgaatggccaacattcgatgttggatggccatcagaggggacctttaattctgaaattatcctggctgttaaggcaatcatttttcagactggacccggatctcatcctgatcaggagccctatatccttacgtggcaagatttggcagaagatcctccgccatgggttaaaccatggctaaataaaccaagaaagccaggtccccgaatcctggctcttggagagaaaaacaaacactcggccgaaaaagtcgagccctctcctcgtatctaccccgagatcgaggagccgccgacttggccggaaccccaacctgttcccccacccccttatccagcacagggtgctgtgaggggaccctctgcccctcctggagctccggtggtggagggacctgctgccgggactcggagccggagaggcgccaccccggagcggacagacgagatcgcgatattaccgctgcgcacctatggccctcccatgccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaatttggctaaggtaagagaggtgatgcagggaccgaacgaacctccctcggtatttcttgagaggctcatggaagccttcaggcggttcaccccttttgatcctacctcggaggcccagaaagcctcagtggccctggccttcattgggcagtcggctctggatatcagaaagaaacttcagagactggaagggttacaggaggctgagttacgtgatctagtgagagaggcagagaaggtgtattacagaagggagacagaagaggagaaggaacagagaaaagaaaaggagagagaagaaagggaggaaagacatgatagacggcaagagaagaatttgactaagatcttggccgcagtggttgaagggaagagcagcagggagagagagagagattttaggaaaattaggtcaggccctagacagtcagggaacctgggcaataggaccccactcgacaaggaccagtgtgcgtattgtaaagaaaaaggacactgggcaaggaactgccccaagaagagaaacaaaggaccgaaggtcctagctctagaagaagataaagattaggggagacggggttcggaccccctccccgagcccagggtaactttgaaggtggaggggcaaccagttgagttcctggttgataccggagcggagcattcagtgctgctacaaccattaggaaaactaaaagaaaaaaaatcctgggtgatgggtgccacagggcaacggcagtatccatggactacccgaagaaccgttgacttgggagtgggacgggtaacccactcgtttctggtcatccctgagtgcccagtaccccttctaggtagagacttactgaccaagatgggagctcaaatttcttttgaacaaggaagaccagaagtgtctgtgaataacaaacccatcactgtgttgaccctccaattagatgatgaatatcgactatattctccccaagtaaagcctgatcaagatatacagtcctggttggagcagtttccccaagcctgggcagaaaccgcagggatgggtttggcaaagcaagttcccccacaggttattcaactgaaggccagtgctacaccagtatcagtcagacagtaccccttgagtagagaggctcgagaaggaatttggccgcatgttcaaagattaatccaacagggcatcctagttcctgtccaatccccttggaatactcccctgctaccggttaggaagcctgggaccaatgattatcgaccagtacaggacttgagagaggtcaataaaagggtgcaggacatacacccaacggtcccgaacccttataacctcttgagcgccctcccgcctgaacggaactggtacacagtattggacttaaaagatgccttcttctgcctgagattacaccccactagccaaccactttttgccttcgaatggagagatccaggtacgggaagaaccgggcagctcacctggacccgactgccccaagggttcaagaactccccgaccatctttgacgaagccctacacagggacctggccaacttcaggatccaacaccctcaggtgaccctcctccagtacgtggatgacctgcttctggcgggagccaccaaacaggactgcttagaaggtacgaaggcactactgctggaattgtctgacctaggctacagagcctctgctaagaaggcccagatttgcaggagagaggtaacatacttggggtacagtttgcggggcgggcagcgatggctgacggaggcatggaagaaaactgtagtccagataccggccccaaccacagccaaacaagtgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccgaggagttttaacccaaacgctaggaccatggaggagacctgttgcctacctgtcaaagaagcttgatcctgtagccagtggttggcccgtatgcctgaaggctatcgcagctgtggccatactggtcaaggacgctgacaaattgactttgggacagaatataactgtaatagccccccatgcattggagaacatcgttcggcagcccccagaccgatggatgaccaacgcccgcatgacccactatcaaagcctgcttctcacagagagggtcactttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaggatggctggggcggcggtggtggacgggacccgcacgatctgggccagcagcctgccggaaggaacttcagcgcaaaaggctagctcatggccctcacgcaagctttgcggctggccgaagggaaatccataaacatttatacggacagcaggtatgcctttgcgactgcacacgtacacggggccatctataaacaaagggggttgcttacctcagcagggagggaaataaagaacaaagaggaaattctaagcctattagaagccttacatttgccaaaaaggctagctattatacactgtcctggacatcagaaagccaaagatctcatatctagagggaaccagatggctgaccgggttgccaagcaggcagcccaggctgttaaccttctgcctataatagaaacgcccaaagccccagaacccagacgacagtacaccctagaagactggcaagagataaaaaagatagaccagttctctgagactccggaggggacctgctatacctcatatgggaaggaaatcctgccccacaaagaagggttagaatatgtccaacagatacatcgtctcacccacctaggaactaaacacctgcagcagttggtcagaacatccccttatcatgttctgaggctaccaggagtggctgactcggtggtcaaacattgtgtgccctgccagctggttaatgctaatccttccagaatacctccagggaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaaaaaaatactggaggaaatttttccgagatttggaatacctaaggtaatcgggtcagacaatggtccagcttttgttgcccaggtaagtcagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccctatgaattgctctacgggggacccccccgttggtagaaattgcttctgtacatagtgctgatgtgctgctttcccagcctttgttctctaggctcaaggcgctcgagtgggtgaggcaacaagcgtggaagcagctccgggaggcctactcaggagaaggagacttgcaagttccacatcgcttccaagtgggagattcagtctatgttagacgccaccgtgcaggaaacctcgagactcggtggaagggcccttatctcgtacttttgaccacaccaacggctgtgaaagtcgaaggaatctccacctggatccatgcatcccacgttaagctggcgccacctcccgactcggggtggagagccgaaaagactgagaatccccttaagcttcgcctccatcgcctggttccttactctaacaataactccccaggccagtagtaaacgccttatagacagctcgaacccccatagacctttatcccttacctggctgattattgaccctgatacgggtgtcactgtaaatagcactcgaggtgttgctcctagaggcacctggtggcctgaactgcatttctgcctccgattgattaaccccgctgttaaaagcacacctcccaacctagtccgtagttatgggttctattgctgcccaggcacagagaaagagaaatactgtgggggttctggggaatccttctgtaggagatggagctgcgtcacctccaacgatggagactggaaatggccgatctctctccaggaccgggtaaaattctcctttgtcaattccggcccgggcaagtacaaagtgatgaaactatataaagataagagctgctccccatcagacttagattatctaaagataagtttcactgaaaaaggaaaacaggaaaatattcaaaagtggataaatggtatgagctggggaatagttttttataaatatggcgggggagcagggtccactttaaccattcgccttaggatagagacggggacagaaccccctgtggcagtgggacccgataaagtactggctgaacaggggcccccggccctggagccaccgcataacttgccggtgccccaattaacctcgctgcggcctgacataacacagccgcctagcaacggtaccactggattgattcctaccaacacgcctagaaactccccaggtgttcctgttaagacaggacagagactcttcagtctcatccagggagctttccaagccatcaactccaccgaccctgatgccacttcttcttgttggctttgtctatcctcagggcctccttattatgaggggatggctaaagaaggaaaattcaatgtgaccaaagagcatagaaatcaatgtacatgggggtcccgaaataagcttaccctcactgaagtttccgggaaggggacatgcataggaaaagctcccccatcccaccaacacctttgctatagtactgtggtttatgagcaggcctcagaaaatcagtatttagtacctggttataacaggtggtgggcatgcaatactgggttaaccccctgtgtttccacctcagtcttcaaccaatccaaagatttctgtgtcatggtccaaatcgtcccccgagtgtactaccatcctgaggaagtggtccttgatgaatatgactatcggtataaccgaccaaaaagagaacccgtatcccttaccctagctgtaatgctcggattagggacggccgttggcgtaggaacagggacagctgccctgatcacaggaccacagcagctagagaaaggacttggtgagctacatgcggccatgacagaagatctccgagccttagaggagtctgttagcaacctagaagagtccctgacttctttgtctgaagtggttctacagaaccggaggggattagatctgctgtttctaagagaaggtgggttatgtgcagccttaaaagaagaatgttgcttctatgtagatcactcaggagccatcagagactccatgagcaagcttagagaaaggttagagaggcgtcgaagggaaagagaggctgaccaggggtggtttgaaggatggttcaacaggtctccttggatgaccaccctgctttctgctctgacgggacccctagtagtcctgctcctgttacttacagttgggccttgcttaattaataggtttgttgcctttgttagagaacgagtgagtgcagtccagatcatggtacttaggcaacagtaccaaggccttctgagccaaggagaaactgacctctagccttcccagttctaagattagaactattaacaagacaagaagtggggaatgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgacagccctagtgacctatctcaactgcaatctgtcactctgcccaggagcccacgcagatgcggacctccggagctattttaaaatgattggtccacggagcgcgggctctcgatattttaaaatgattggtccacggagcgcgggctctcgatattttaaaatgattggtttgtgacgcaca

SEQ ID NO: 117 - DNA, 8746 bp, Artificial
  ss1014 sequence
tgctcaggttcttagggaggaacactgtctgcttggggatgggggaggtccaggatgcttacatgggaaaatcaagaccttgtagtgtataaaagttactgagaacaaagacctggtgctcagactctggaggtgactcctctgagcccggcaccggtgctgaataaaccttgcttttccatatctctgagtgctgtttgtcttcttccattgccatggtttttgcggtttctgcaacattttggtgcattggccaggaagccgacaaccgagctggcttcttgtgtcaccgttgtcagggaaccgggggaggccatggtcgccggcccagtgacaggtggatagtactcactggccattttgccagatccagaccctcactcgggccatggccttggcccacgccacttcccgaatggactcagaaggagagtggaaacaggttcctggacaggacgtcagactggtgagtgccccggggacatctgcccaagtcaggacccgccatacggcagaaggagagactgatcacctctcagtgaccaaagggtcactcaggtcagggtttgctcccttgggatcgggaggcttgtcaattctggtgtgtgtgtgtgagtgactggagagaacaagagcccatgctccaccgtctttggactacatagccagagtgagtcctaacctgcagttacgcggcgaccctcatacagcttatggtggccctcttcggggggatcctgacgttggggtttatacagacccatctatgctaagaggcacctgaaatatctcctccaggggagcggtcaggcggacgaagcgattctgaggccttgacctcactgtttgtcttgcgtcaccggcacagggtgggacttcacacaatgggtaaatcagcttccaagcccactgtcttagagtatatggttaagaattttaagaaaggattttctagagattatggtgttaaggtgagtcctggaaaactgtgtactctctaccctagagtggccctcctttggtgttggctggcctccagaagggaccttagatgtgttcacagttgcagcagtatataatgttataacaggagaccctggacacccagacccatttctgtatattgatcaatggttggaaattgcctatttgaggcccccatgtgttcggttctgaaccacagaccagggacagtgtagggtgctagtagcccagtccaagaagaaaaccttgtctcaaaagaaggtgccacctatttatcaaggggaacctgaggacttgccccctatgccaccaccttatgtgctgccggccccacctccaggagccaaaggtccccagatgccagatagcccactgccttctgtttctcctcctccttctgcttctgaagttcccaaggcaatatcacccccgcagccagattctccagaacctatgagcaggcgtctctggtcagctcagggagcagccactccagcattgcaaatgcccttacgggagacacgaggaccacagcaaatcacccccaatgggaccatacaagaggggggatgtttttattattaccagcccttttccactgctgatctcctcaaatggaaacactatactccctcatattctgaaaagcctcaagtgctgattgatctcttagaattcattttccagacacactgtcccacctggatagactgctggcaactcctttttactctatttgacactgaagagcactggtgaattgtaacaggagcccaaaaatggcttcaggccaatgcggggggtcgagcagacttggcaaactgggtgagggaagacttcccagaagaaaacccccactgggactatgacactgaagaagggaaacgtaacctagagaggtactggcaggccttcctacagggggcaaaagcaggggctaaaaagcccactaatatagctaagatcagtgagatacacaagagccaaatgaaagcccagccaaattctatgagagactatgtgaggctttccgaacctacactccttttgatcctgaggcccctgagaaccaacggatgataaatgctgcctttgtgggacaagcccaatccgcaaaaagctacagaaattagaaggctttgcaggagagaatgccattaaactgttggaaatagccaacaaggtttttattcaccgaaaccaggtggcccactgtgatgtagaaaagagaatgaaacaaaaagtgactcttctggcagctgccctgtcaaaaccggtgcccccactgggaccaccctgtaggggacaaggcacaaggccagggaaaaggagtcccctggaacatgaccaatgtgcttactgcaaagaaaagggacattggaaaaatgaatgccccaaccatcctgagaaaaagaccaaggccccacctagccggtactgatctgagccattcagcaccaacctgattggcctagctgagtctgattaggggggaccaggctctctccaactgagcctatgactctccctaatcagcctatggtcagaattcaaatagggggccaccccatagactttatggttgacacaggtgctgaactttttgtggttacacaacctgtggctcccctcttggggaaagaaaccaccattgttggggccacaggtaaacaaacccacaggcccttctgcggtcctcgatgatgtcagttaggaggccatgaagtaatacatgagtttctttacctgcctgattgcccagtctccctgatgggaagagacctgctggctaaaatgggggcacaaatttccttttctactgatggatcagcccaacttaaattgacagaacccccctctcctttaatcatggctcttgctgtaaaaagagaagaggaatggtgcttgtactcttccccttcagaaatggggacaattcccccagaactagagactaaatacccattggtttgggctgaaggaaacccaccaggactggcaaaatgccacgctcctgtcttaattgatctaaaacccagagctcaactggtaaaactacggcaatactcaattcccagagaagcttgactgggaatccaggttcacctggataggctgcttcagaatggactgttaataaaatgtcagtccccttggaacacccctttactgcccgtgaaaaaaccgggaacacaggactaccgcccagtacaggacttgagagccataaatgaagcaacagtcacattacacctgtccgtccctaacccatataccctgctggggctgatcccctccactgctgaatggcttacttgcctggacttaaaagacgcttttttctgcctctgggtggcacctgccagtcagcccatttgcttttgaatgggagaatccacatacagggacaaaggaacagctcacctggactagactcccacaggattcaaaaactctcccactctttttagtagcgccttagctgctgacctggctgaatttcctggacaaaaactgggctgtgttttgctacagtatgttgacgacctcttactagctggcaccacggaggctcagtgcctagagggaacaagagctctcctttccctactgatggaggcagggtatcgggtatcaaagaaaaaggcacaaatctgcaaaaaacaagtcaagtatctgggcttaaacatcatgcagtgctgatgaatgctggggactgaaagtaagcaggcagtttgtgccattcctgtccctaccacccaccggaaggttcgtgagttctaggggcagcaggatcctgctggatatggatccccgggtttttagacctggccagccctctgtatgaggctctaaaaggggaagaaaaggctccccttaaatggggaccaagccaggagacagcatttcagacaatcaaaaccaaactcactgaggctccagccttgggacttcctgatgtaaccagagaatttaaccttttgttcatgagaaaaatgggatggctgtgggagtcttgactcaagaatttgggccttggcagaggccagtggcatatctgtctaaacaaattgactcagttgctgctggatggcctccctgcctccgagcactggcagctaccaccttgttggtaagagaggctgacaagttgaccctgggacaaaacctcaatgttaaagtcccacactcagttgtaaccctaatggatatcaggggccaccattggctcacacatgcacaaatgactcaatatcaagggttactatgtgaaaatccacgggtaaaattggaggttgtacgaactctgaacccagccacttttctgccagatgaagcggggcccccagaccataactgcctggaggtactagataaggtgttttccagcaggcctggcttgactgataaaccactccaaaatcctgacctggttttatatactgatggcagcagctttatggaggatggaaaaaggatggcaggatatgctgtggtatctgacttaaaagtgataaaagcagaggtgcttcctcaaggctggtcagcacagagggcagaattatgggccttaatcagagcactggaactcagccaagaccagcgagttaatatctataccgactcacgatatgcctttgcaactttacatgtccatggagccttatataaagaaagagggctcctcactgctgaaggaaaaggaattaaaaaccaggctgaaatcttaaagctcctagaggcagtatgggaacctaaagaagttgcagttatccactataaaggccaccaaaagggggatgtcccagtgacaaaaggaaaccatagtgctgatgcagctgccagacaggcagcccggggacaacagccagacaaacctaaggtcttgctggccccagaagtgccagctgtccccaaatattctccagaggaagaaaaatggataagggaggaaggaggaactaaaactaaaatgggatggtgggtcacacaggaccaccgagtttacattccagaacagctggcctacaaactagtccgccaagaacatgagctaacccacatgggcaaaactgccttagagaccctactgggctggtactatctcattgctcatcttcctgcactctgctcctctgtctcccaaagatgcgtaacctgtttacagaataatgcccaccaggggccccacagaccagctggggcacagcactgcggactatccccatttgaggatatgaaagtggactttactgaggtcacccctagtaaggggtacaaatatttactagtttttatctgtactttttcaggatgggtagaggccttctctacccgaactgaaaaggcaagggaagtaaccaaggcactcctgagagacattattcccagatatggaatgcctctgaccatcgggtcagataatggaccggcatttgtggccaaaacagtacaacaggtggcaaaagctttacagatccaatggaaactacattctgcttatcgccctcaaaattcagggaaagtagaacacatgaaccaaacacttaaacagaccctggcaaagttacatcaggaaactgacttgccctggatagacatgttgccagtggccctcttaaaagtaagatgctcaccctgagcgggaataggattcttgccatttgaaatcttatatggaaggccacctccactaatcagtttaaaaggaaataccagggagttgggagatttggaattacataaacaattacaaggactggggctcactatttctcagatacatagatgggtcacagacagaatacctgtgtccttaggtataacaatacacccccacaagccgggggaccaggtgtggataaaggactggaaaaaggagcctttgaggctggtatggaaggacccctatactgtaattctaaccacccccactgctcttaaagtaacaggaatagatgcttggatccataattctagagtaaagctggctggcacagctgacgaccgtggagagtgggagactgccctcgatccagagagacctcttcgcctgacaatacagagaaggagatgatgatctcaaagccctgcagttatccactataaaggccaccaaaagggggatgtcccagtgacaaaaggaaaccatagtgctgatgcagctgccagacaggcagcccggggacaacagccagaaagctggtcagtcaacgcagggctgaagcttgaggaattggcagcctggtaaaataaactgccttacctcccttccacaagagactctctaactgtcatatactgttatcttatgaccaacatgtatgtttgctgcctgttgctgttaatctggtcccctttagttctgtcaggatccatgtcctcatgtgacccgtattcgagtgacccgatcagatcaaggggttatatggactttgctttactccactcatttctcctgttctggagaaattcatggaagttgtactcacaacaggaccacttattctatctgtcaacagggagaccaatatacttgctttgatccacgatactcaccaactgaggaatggttagaagtctggcactctcataaatcagggcagctaattaatcagacccaaattaccaaccccaagttgacagtatcaatactttttgatgcctgtgaagctatgaatgggtcatggacttctactaaaccatgtggaagcccatcatgggaaagagaatataggctccagcataaatatatgtgctgggggaccacctggagcaattgcctggaatgcacttactggagctgtgtggcctgggcaacctggaataagggagacaaaacagctgtccttcaaaagggtacagcccctccagactgccagactaaagcttgtaacccagttaatttcactattttcaattccagtgagcccaaatggaaggagggtttcaaaataagcatttgcattgacggaagaggccttgaccctggagctgtgctacatttccagagaatcacgtttgcactccaagctgcctctcacagcgtctttcattcctcttatgaagagataagaaacaccccacctcccattccagccacaactaagaacttgttcttagccctggcagaaactattgcacaaactctcaaggtctcctcttgttatgtatgtgggggaatgaacacaggagaccactggccttggcaagccagagaactggacccattagagcctcataatgagactgcatacccccaactcaccaatggagtatggctcctcagaactgctattatagggagaaattgtcttgcgaggcggggaggatggtttaatgtttcagttggaagcttaacatgtttaggcctaaggtattataatctgattgcccaaaagactcaatggtggtcatcctccaatcgctcagagcccaagcctaatcccttatctaacttttcccaccttcgacaagcatgggaagatatcagtactaatatccagtggcgggcaccaaagggattatattggatttgtggaaaaatggcctattccatactccccccaaattgggctggggcatgtgtactgggaacaatcagaccttccttcttcctgctcccgctgtcactaggggagcaactgggagttcctatatatagggcacagggtgcccagagagaccggagagctcttcaaattggagacttgaaagatgatgaatggcccccagaatggataattcaatatcattgacttgccacctgggcagaggatggctcttggggatatcgcacccctatctatatgctgaaccgcatcatcagactacaggcggttttggaacttgtaacaaatgacactgcaagggccttgactatattggcccaacaacaaactaaaatgtgcagtgcagtctaccaaaatcacttggccttggattatttacttgcttctgaaggaggggtttgtggaaaatttaacttaagtaattgctgtctacaaatagacgacactggaaaggtggtagaaaaaaaattgctgaccgcatgactaaacttgcccatgtgcctgcacaaacttggaaaggatgggatacagacagtctctttggtaaatcgttctcttgattgggaggaattaagacaatggtcggaataatcatggttatactcacagggtgcctacttgttccctgccttgtacctctcctgataaatattataaaaggttttataagaaccatggttgaaagaaaaacagcctcccacctgctacttattagaggctaccaaagggttatgactaatgatgatctgtaaagggtgcagatgcaccctgaacatcaagagaggggaatgaaatggagttttaactaaagaacaacccccccttggctaagaaggcagctgcaagcctttccagctgtgctcatcactatgccacccttcttgtaataatgtaacaactgtgcactctctgtccaagccagcagccctgctaatcaggtacccagcattgcttatcagttctgcttctgtaaccttgcttgctcaggttcttagggaggaacactgtctgcttggggatgggggaggtccgggatgcttacatgggaaaataaagaccttgtagtgtataaaagttactgagaacaaagacctggtgctcagactctggaggtgactcctcagagcccggcaccggtgctgaataaaccttgcttttccatatctccgagtgctgtttgtcttcttcca

SEQ ID NO: 118 - DNA, 7260 bp, Artificial
  ss1015 sequence
atgggaaacatctctgaaattccattaggcagttccctgggaaagatctcaggcaactagttgacttacagctatgaaccaatgataagttactgcaccttgcttagttggaagagtctgaagggtctgggctgagtgtttaggtaagaggctgatttgaaaaaggacaagacttctcctgactggttacaattttctcaggcgactgagaaatttaataggggtggtggaggctgaatcctcacatgatgcagtggtcctgtagggaaattcactcattaattaattcttgctcaacctgggatgcaaataagaactggctattcagttatctgagcacctgtggtgttctagatcccactgggaaacctgagacagataagagagagctgaacaacccttaggaaatttattttattcctggtggaattttctcacctggccaattcatacctgctctgacataaatatgaattttcttttagattcactcaatcccagagcaatgagctaagtctcagtcaaaaactgtaacctgcttattaaaaggggacctcccacacttgtgagatggatttagtggttaacacaaagctatggccatttaaatttaaaggttcctatgttgagaacaattaaatcataccaagaatgaccagcctaagtaacattgggaaaataggctgggtgcctgatgaacaatgcttacataatggctggtgtggaaagtgctgggtcagacaactggagattccttaggtcacacctaatgaaattcagtgaatttgtagtgctaattcatggccttggcttccacaaggatggataggaaagtgtactccaggactcccttggacctaaggtcatatacttaatttaaatatgaccccaaacaatctaccaatgggtcaagaaatctgtattctactggaatgacaacttagcagctatttttgtgctgtcagtgggataggagcctataatcagtcacatcaaatccttaaagaaattcactcaaacagactttaaatgaccataaccaggctcttagcctactgaattttgagttcctacgctgctttaagtgacctgctccctagtcttgacaacatcctcttctaaaagtggtttggagcaggaagctgttggcttaaatatttgcttatatctccgttactgttattagctatagttcttatatttgcctgctttgcaagattttttttttcttgtattacctaatgtgtggctgagtctcaaagaaaaataaggtggcttgaagcaataagtcctcctagggtcaaggagaactcccctacacatgtacataaagactcctaggggtcaaaaaggtagagggtgccaagtcataataaatcctgataactcagtgagttaatgatccagcattgctgcaagctgtggcataagttgcagatgtggttcagatcctgtgttgccttggctgtggtataggcttgcagctgcagctctgatttgacccctagcccaggaacttctataagccacaggagtgactgtaaacagaaaaaaaaatggccaaaggaaaacaaaaatctaaaagaactgccccatataagtggttctggcatgctcttcattcaggaggatgcccacactcacactcctcttttggatgtttattatttgcttctgtcttaaacaaactacttctctgtgtagggatgcagtcccagggtatgaccacattgggactatgaagataacataagtcaggttagggtgagacattatattatttgtctatcagagggaatgaaaaggtgaatgttgaagcctgtgtattataagggctgagtggtcacacaagaaaaggatgaaaactcagctgtcttcctgagctgggtgacagaggcatcaggaaggacaataatagagaccctgagtccacagaaaggaaaacactcttggctatgcatattatcagctaggccactcctgataccaggagaaaattaccaaatcttgaggctgtgccacaaaccccatcgtcaaccttggtaagtaggccttcaagttttataccaaccgagacttaacagaggagaccaatggcaacaagaggagaggctagtgaagaaaatgaagcttctggttgctctgattcacccatgaccttgaggggatcctggagggccaaaagtctagaccaacaccaaggaaggcacctgggcctgggccattgtgcaatttgggtgaaggagaggcactggaagggggaatgtctgcagcaccctcctgtgggacacctgaggggaaaccttatttggccccagtatcttgtgaggtttttttttgtctttttgccatttttagggccactcccacagcatatggaggttccaaggctaggggttgaatcggagctgtagctgctggcctacgccacagccacagcaacacaggatctgagctacatctgcaaactatactatagctcacagcaatgctggatccttaacccactgagcaaggccagggatcgaacctacaacctcatggttcttagtcggattcgttaactgctgagccatgatgggaactccatgtgtcttttggatgagagagtcccacacactgactataagcccaagagcctgcccagctccagattccccttgattcatcctcaacactccaatggagtctctggtcaccctcaatatggtgggtaggataagtgaatttcttgtagaccctggagccacctactctgttctgcagtggccagctgccccctcttcagctgtgactgaactgtgatgggacacgatggacagccaaagggaaggagattacatctcccctctcctgagaagccaggtccatcatcatgactccctcttttgtggatgtgccaggatgccctgccaactacttggaagagagctgctatataaatcagctagcagagtcttaggacagggtgaagtccaaggaagtgggaaatcaagcagggtatgaatctattggtagccccagggacccatctgctggtcatcaaaattgtccccaagacatccccaagaaatgagaggaaaatagatcctgtgttttggaacacctcagttgcaggaagggcaaaacatgttccccagtaaaaataaggttaaggcctggggaaaagtacacatggaagagacaataccctttaaaaactgaggccctgaggagaatccatccactgctccccaaactcctaaaacacagacaaattgggccctccctatctctgagcaacacccccatcctcctcattcagaagcctaatgggttgtattggtttgtgcaagacttatgagcagtgaatgaggccatcatcccagtcatccactggtactgaacccataaagtatcctcacccaagtgctggggagtgctcagtgtatctcttcttttgcacctcaatgatgcatttttctgtgttccctcacatccagattctccatacatttttgtctttgtatggagggaccctgacacctggagtctacctgatatacctggatagttcttcttcaggcttttcaggacagcccccatctttttgaaaatgcattcataagggagctgagaaaactgagccttgagaattctactacaatatgttgatgattttttaattctactacaatatgttgatgattttttaaagttgtgaaaccaaacagggttcagatccaaatatttttaaggtcctgacaaaaatgggatataaatcacctcaaacaaggaccagatctcacagcaatgggttcaaaatttaggatttgttttgaacccaggggcatgagccctgaccatagattgaaaaacaaccatcagtatattaccatattcaaccatagagaggcagctctgagcctttcttggaagggctgggtttgtcatacctggattccaaattatggcctaaagccaaacatctatatgaggctctgaagagagaggaaagggaaaaatttcaatggaataggcacaactagtgggaattttgagcctctaaagactgagttgagtagaaaaccagtcctggggcttccaaatttggacaagccctttaccctgtacattcataagaggtcagggatggtgctaggtgcccttacccaaaggctgggactggatcagagacaaggggatttcttttcaaaacaactggaatctattgccctgggatggcccagctgcctgtgggcagtagcagtcatagccctgctggtaaatgaggcttccaagctcaccctgggacaacactaagatgcactcacccctcatcaggtacagtctgtactggagtcaaaggacaatattggctgactggaggaaggttaacaagatattaggccctcttaaaggacacccccaatgttactataaaggtatgccacaccctgaactcaacaactctgcttccagtggtcaagagtgaaaacttattgcatcagtttttggagaccatagaacaaacttactccagaagatctgatcttctagatgaacctcttgacaacccttaggaagcatggtttactaatgtggggcagttttatagaaatgggaaattgagaggtggggtattccaaggccctgccaccccaggcatcatcccataaggccaaattagttgcattaatgagagctttgcaattagggtgggataagaaattaaatgtttttacttgattccatgtgctacatgctcatgctgccattttgaaaaaagaggaatgttaacctctagaaattctcctgtaaaacatatagatttgattctggctcttttagaagtagtacagctcccaattgaggtagcagtgatccactgtaggggccatcagaaggattgatattttgtgagacaaggaaggagcaaagctgatcaaacttcaaaacaggctgctctattgcaggagcctgagcaagttatggccctagtgactggtcctccaaacccctcagccttccccagtgtcccctgcagggacaggaaatgctgagcaattggggtctgagagaggaagcaaaggctggtagaaaaaggagggtaagattcaaatccctgagtcccaacaatggaaactcactaagagcttatgtgatgcacccactgtgggaggaaaacacaatgggacttaaagcaaaagcccttttcagggcagcagcttaaaagatccctaaaaagggtaatacattcctgtgatttatgttcctataataaacttgcaggcccctctaaccccccccttcactactcaggagagttcattgctgatggacatatctgggggaagactggcagttagatttcacccaaatgctcccatgatcaggatacaaataatcttcttgtgcttattgatacttccatgggatgggttgaagcctttcccatcaattcggaaaagactatggaagtctgcaagtcccttgtagaaaaagtaattactcactttggacttccaaatccttctagagcaataacacgccctacttcagagccataaccacacaggggctcatatcagccctcaggatagatcacacgctacatactttttggcatcctcagtttctgcgaaggttgagaatgagccacactttaaagaaaaccttagtaaagctctgtcaagaaacccatgaaccttgggccaacctgcttcctactgtgttcttcaggatatgtgtaaccctcaggagtggtttgagcttagtctttttgaaaggacctattggaagcctttacactgataaggaagcggactaggccctgagatatattattaacctaggacaaattcagaaggcagtagaggattatgtacacagggcactgccagatcccactggaaatagagaggaagaggttccttcaccaataaatcccaggggtcaagtccttctcaaaacctggaaaaaggggtccactaaagaccaatgactgccaaaagggaagggcccctataaagtaattttacctaccgccactgctgtcaaattgcaagcaatggccagttgggtagatttgtccagactaaagctttgcctccagaaaccccacagttcacaactgaaggacagtatacctgtgagccagtggaagctctgagatacctattcaaaaggcaggccccatcaacagataaggaaaattatgcagtgtgttgaatttcttggtcattctgtctcttgtactcagcaggatcacacatgagcatctttttagaaatgttctagagcttcatatgctcaattatcaacataatgttctgctgtcctctaattgttaaagtactaacaattatatacttaaagaacataacagtcacgagacaaaccaccatgagacaaacattcagatctgcaccccttaagggttcattttccttggcagacacccaaaccatcatatatattggaattatggccagaccctgtccttttctaaccaaactatggcccataaatgcatagataatgaagagtacattatagggattttcatctctaatggaaccactcaaggcccactactgaacctggaaagcactaaggatcctagcaggggtaggactgaccatagggctggcaccaccatgggtaggctttacctaccataaagcaacaatgggaaatctcatcagacagcatgcttatatgttggaacagataggacaagccttgaggggacttaagacttctgtttttcctttggctaatggagtttgtgacagttgtctagctcttggcataaaatctctcacagggaaataagacaggctgggacctgggacatgggacctggaatcctttgccccagtagttgcaatgcttgcacccggacaaacatctcaaccaacaaaatacaaagaaactacaagggactaaaaataactgtgtacatggagagttggggcaaattatgggcaagaagacacaaaaacctaaaaacccaactgcaactttttaagagcagggagcaaaacagggtactatgcatatcccttgcatgcaccaccacaaaaggagtgggcagaccacctaagccaccactctggcccaaccccattgaatgtaactgcctgccttgacaggcacaataatagccacttgagtgtgttgtctcacaataggaagtcctgataagggacgtggtgctgccctgaagactcaccaggagatatttgggaggggccaagtggagggaagagaagactg

SEQ ID NO: 119 - DNA, 8643 bp, Artificial
  ss1024 sequence
  misc_feature (5951)..(6050): n is a, c, g, or t
  misc_feature (6085)..(6085): n is a, c, g, or t
tgtgtgccctatgtccaagccagcagctctgctaatcatgtacccaacattgcttatcagttctgcttctgtaaccttgctcgctcagtttcttagggaggaacactgtctgcttgggaatggggggaggtctgggatgtttatatgggaaaatcaagaccttgtagtgcataaaagttactgagaacaaagacctggtgctcagactctggaggtgctgagttcacatcggtgctgaataaagcttgcttttccatgtctctctctgagtgctgtttgcctccttccattgacacggtttttgcggtttccacaacatttttggtgtgttggccggtaagccgacaaccgagctggcctcttgtgctaccattgtcggggaaccaggggaggccacagtcgctggcccggtgacaggtggatagcgtgcaccagccattttgccggatccagaccctcactcatgccgtgctgaccttggctcacaccacttcctgaacggactcagaaggagagtggaaataggttccaggacaggacgatggactggtgagtgccccggggacatctgcctgagtcaggacccgtcatatggcagaaggagagattgatcacctctcagtgatcaaagggtcacttaggtcagggtttgagaccttgggatcaggaggcttgtcaattctggtgtgtgtgtgtgtgtgtgtgtgtgtgtgtgtgtgtgtgtgtgtgtgtgtgtgtgtgtgtgtgtgagactggagagaacgagagcccatgctccactgtctttggactatggagccagagtgagtcctaaccggcagttccgtggcgaccctcatacagcttatggtggccctctttgggggggatcctgacattggggtttatacagtcccacctatgctaagaggtgcctgaaatatctcctctgggggagttgtcaggcggactcagcgattgttaccttgtcctcactctttgtcttgtgtcaccgtcacagggtggaacttcacacaatgggtaaatcggcttccaagcccactgtcttagagtgtatggttaagaattttaagaaaggattttctagagattatggtgttaaactgagtcctggaaaactgtgtaccctctgtaccctagagtggccctcctttggtgttggctggcctccggaagggaccttagatgtgttcacagttggaagagtatataatgttataacagaagaccctggacacacagaccaatttccgtatattgatcaatggttggaaattgcctatctgaggcccccatgggttcggttctgcaccacagaccagggacaatgtagggtgctagtagcccagtccaagaagaaaaccttgtctcaaaaaaaggtgccacctatttatcaaggggaacctgaggactcgccccctacgccaccaccttatgtgctgccggccccacctctgggagccgaaggtccccaaatgccagatagcccaccgccttctgtttctcctcctcctctgcttctgaagttcccaaggcaatgtcacccccacagccagattctccagaaccaatgagcaggcgcctccagtcagctcagggagcagccactccagcattgcaaatgcccttgtgggagacacagggaccatggcaagttgcccccaatgggaccatacaagaggggggatgagttttttattaccagcccttttccactgccaatctcctcaagtggaaacaccatactcccttatattctgaaaaacctcaggtgctgattgatctcttagaattcattttccagacacactctcccacctggacagactgccagtaacttctttttactctgtttgacactgaagagcactggtgaattgtaacagaagcccaaaaatggcttcaggccaatgggggggggggtcaagcagacttggcaaactgggtaagggaaggcttaccagaagaaaacccccactgggattatgacactgaagaaggaaaacgtaacctagagaggtaccagcaggccttcctatagggggcaaaagctggggttaaaaggcctaccaatatagctaagatcagtgagatactacaagagccaaatgaaagcccagccaaattctttgagagactatgtgaggctttctgaatctacaccccttttgatcccgaggccccttgagaatcaacagatgataaatgctgcctttgtgggacaagcccaatcagatatccctaaaaagctacagaaattagaaggatttgcaggagagaatgccactaaactgttggaaatagccaacaaggtttttattaaccgagaccaggtggcccgccatgatggagaaaagagaatgaaacaaagtgactcttttggcagccgccctgtcaaaaccggtgcccccagtgggaccaccccgtaggggacaaggcacaaggccagggaaaaggagtcccctggaacatgaccaatgcgtttactgcaaagaaaagggacattggaaaaatgaatacccaaactgtcctgagaaaaagaccaagtccccacctagccagtaccaatctgagccattcagcaccaacatgatcggcctagctgagtttgattaggggggaccaggctctctccaactgggcccccgagagcctatggtcagaattcaagtagggggccaccctatagactttatggttgacacaggtgctgaactttctgtggttacacaacctgtggctcccctctggggaaagaaaccaccattgttggggccacaggtaaccaaacccacagacccttttcagtcctcgacgatgtcggttaggaggccatggagtaatacatgaatttctttacctgcctgactgcccagtccccctgatgggaggagacctgctggctaaaacgggggcacaaatttccttttctactgacggatcggcccaactcaaattgacagaacccccctctcctttaatcatggctcttgctgtaaaaagggaagaggaatggcgcttgtactcttccccttcagaaatggggaccattcccccagaactggagactaaatacccattggtttgggctgaaggaaatccaccaggactggcaaaacaccatgctcctgtcttgattgatctaaaacccggggctcaaccggtaaagctatgacaatactcaattcccagagaagctcgactgggaatccaggttcacctggataggctgcttcagcacagactgttaataaaatgtcagtctccttggaacacccctttactgcccgtaaaaaaaccaggaacacaagactaccacccaattcaggacttgagagcctgaagcaacagccacattacacctgtccgtccctaacacttataccctgctagggctgatcccctccactgctgagtggtttacttgcctggacttaaaagacacatttttctgcctccgggtggcacctgccagtcagcccttgtttgcttttgaataggaaaatccatatacagggacaaaggaacagctcacctggactagactcccacaaggattcaaaaactctcccactctttttagcggcgccctagccactgacctggctgaatttcctggacaaaaactaggctgtgttttactacaatatgttgatgacctcttactagctggcaccacggagcctcagtacctagagagaacaagagctctcctttccctactgatggaggcagggtatggggtatcaaagaaaaaggcacaaatctgtaaaaaacaagtcaagtatctgggctttaacatcatgcagggccgacaaatgctggggatggaaagaaagcaggcagtttgtgccattcctatccctaccacccgctggaatgtttgtgagttcctaggggcagcaggattctgctggatatagatccccgggttttcagacttggccaggcctctgtatgaggctctaaaaggggaagaaaaggctccccttgaatggggaccaagccaggaggcagcatttcagacaatcaaaaccaaactcactgaggctccagccttgggacttcctgatgtaaccagagaatttaacctttttgttcatgagaaaaatgggatggctttaggagtcttaactcaagaatttgggccttggcagaggccagtggcatatctgtctaaacaaattgactcagttgcggctggatggcctccctgcctccgagcgctggcagctaccatcttgttggtgagagaggctgacaagttgaccctgggacaaaacctcaatgtttaagtcccacactcagttgtaaccctaatggataccagcggccatcattggctcacgcatgcacgaatgactcaatatcaagtgttactatgtgaaaacccacggtaaaactggaggttgtacgaactctgaacccagccacttttctgccagatgaagtggggcccccagaccataactacctggaggtactagatgaggtgttttccagcagtcctgacttgactgataaaccattccaaaatcctgacctggttttatatactgatggcagcagctttatggaggatggaaaaaggatggcaggatatgctgtggtatctgacttaaaagtgatagaagcagaggtctttcctcaaggctggtcagcacagagagcagaattatgggccttaatcagagcactggagctcagccgagaccagtgagttaatatctatattgactcatggtatgcctttgcaattttgcatgttcacggagccttatataaagaaagaggactcctcactgctgaaggaaaagggattaaaaaccaggctgaaatcttaaagctcctagaggcagtatgggaacctaaagaagttgtagttatccactgtaaaggccaccaaaagggagatgacccagtgacaaaaggaaactgtagtgctgatgcagctgccagacaggcagcccggggacaacagccagacaaacctaaggtcttgctggccccagaagtgccagctgtccccagatattctccagaggaagaaaaatggataagggaggaaggaggaactaaaactataacaggatggtgggtcacacgggaccaccgagtttatgttccagaacagctggcctacaaactagtccaccaacaacacgagctaacccacatgggcaaaactgccttagagaccctactgggccggtactatctcattgctcatcttcctgcactctgctccactgtctcccaaagatacataacctgtttgcagaataatgcccaccaggggcccaatagatcagctggggcacaatactgtggactgtccccatttgaggatatggaagtggacttcactaaggtcacccctcataaggggtacaaatatttactaatttttatctgtaatttttcaggatggtataggccttccctacctgaactgaaaaggcaagggaagtaaccaaggcactcctgagagacactattcccagatatggaatgcctctgaccattgggtcagataacggaccagcatttgtggccaaaacagtacaacaggtggcaaaagctttacagatccgatggaaactacactctgcttatcgccctcaaatttcagggaaagtagaatgcatgaaccagacccttaaacagacattagcaaagttatgtcaggaaactagcttgccctggatagacatgttgccggtggccctcctaaaagtgagatgctcaccctgagtgggaataggattctaaccatttgaaatcttatatgggaggccacctccactaatcagtttaaaaggaaacacctgggagttgggagacttggaattacacaaacaattacaaggattggggatcactatttctcagatacataaatgggtcacagacagaatacctgtgtccttaggtataacagtacacccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctgacaactgtggagagtgggagactgccctgnatctggagagacctcttcacccgacaatacagaggaggagacaatgatctcaaagccctgccctgactgcaccagaagctggtcagtcaacgcagggctgaagcttgaggaatcagctgcctggtaaaataaactgccttacctaccttccacaagagactttcttactgttatatactgttgtcttatgaccaacatgaatttttgctgcctgttgctgttaatctggtcccctttggttctgccaggatccatttccttatgtgacccatgcattcgagtgatccgatcagatcaaggggttccacagactttgctttactccactcatttctcctgttctggagaaattcatggaaattgtactcacaacaggaccacttattctatctgtcaacagggggaccaatatacttgctttgatccactatactcaccaactgaggaatggttagaagtccggtgctctcataaatcagggcagctaattagttggactcaaattaccaaccccaagttgccagtatcaatattttttgatgcctgtgaaactatgaatgggtcatggacttctactaaaccatgtggaagcccatcatgggaaagagaatataggctccagcataaatatgtgtgctgggggaccacctggagtggttgccaggaatgcacttactggagctgcgtgacctgggcaacctggaataagggagacaaaacagctgtctttcaaaagggtacagcccctccagactgtcagacaaaagcttataacccattgacggaagaggcctagaccctggagctgtgctacatttccagagaatcgtgtttgcactccaagctgcctctcacagggtctttcactccttttatgaagagataaaaaacaccccacctcccattctggacacaactaagaacttgttcttagccctggcagaaactattgcacaaactctcaaggtctcctcttgttatgtatgcaggggaacgaacataggagaccactggccttggcaagccagaaaactggacccattagagcctcataatgagactgcatacccccaactcaccaatggggtatggctcctcagaactgctattagagggagaaattgtcttgcggggtggggaggacagtttaatgtttcagttggaagcctaacatgtttaggtctaacatattataatctgactgcccaaaagactcaatggtctgcccaatctctcagagcccaagcctaatcccttgtctaacatttcccaccttcgacaagcatgggaagatatcggtactaatatccagtggtgggcaccaaagggactatattggatttgtggaaaaatggcctattgcatactccccccgaactgggctggggcatgtgtactgggaacaatcagaccttccttcttcctgctcccgctgtcactaggggagcaactgggagttcctatatatagggcacagggtggccagagactggagggttcttcaaattggagactggaaagatgatgaatggcccccagaatggataattcaatattatggggctgccacctgggcagagaatggctcttgggaatttcgcacccctatctatatgctgaaccacatcatcagactacaggtggtttgggaagttataacaactgacactgcaagggccttgacaacaaactaaaatgcatagtgcaatctaccaaaatcacttggccttggattatttacttgcttctgaaggaggggtttgtggaaaacttaacttaagtaattgctgtctacaaatagatgacactggaaaggtggtagaagaaattgctgaccgcatgactaaacttgcccatgtgcctgtacaaacttggaaaggatgggatacagtctctttggtaaatggttctcttggttgggaggagttaagacaatggttgaaataatcatggttgtactcgcagggtgcctgccttgtacctctcctgataaatattataaaaggttttataaaaaccatggttgaaagaagaatggcctcccacctgctatttatcagagggtaacaaagggttatgactgatgatgatctctaaagtgtgcagatgcaccctgaacatcaagaggagggaatgaaatagagttttaactaaagaacaaccccccttggctaagaaggcagctgcaagcctttccagctatgctcatcactataccacccttcttgtaataatgtaacaactgtgtgccctatgtccaagccagcagccctgctaatcatgtacccaacattgcttatcagttctgcttctgtaaccttgctcgctcagtttcttagggaggaacactgtctgcttgggaatggggggaggtctgggatgtttatatgggaaaatcaagaccttgtagtgcataaaagttacagagaacaaagacctggtgctcagactctagaggtgactcctctgagtccacatcggtgctgaataaagcttgcttttccatgtctctgagtgctgtttgtttccttccattgccatggtttttgcagtttcca

SEQ ID NO: 120 - DNA, 13931 bp, Artificial
  ss1033 sequence
agctctgatagggaacctcctcatgccatgggtgcagccctaaaataacaaaaaaataaaaaataataaaataaaataaaatttaaaaatgtctgggaataaatctaactatggaggtaaaagacctgtgtactgaaaactatagaacaatggtaaaggaaattaaagatgatttgaaaatttgaacaatagtccatttctttttttggtataggaagaattaatattgctaaaatgttaatattaccaaaggcaatctataaacttaatgtttttcttatcaaattatctatgacattgtcaaagaatttgaagaaatagacctaaaatttatgtggaaccacagatgacccagagtttctgaggcaatcctgagagaaaaagagcacaaaactggaggtattccctcatggacttcagacactaccacaaagctacagtaatcaaaacatcatggtattagcacacaaacagacatatagctcaatggaatagaaaagagagcccagaaataaactcatacacctacagtcaatcaatcctcaacaaaggaggcaagaatattaaatgaagaaaagacagtctcttctaaagcagtatcgggaaagcttgacagtcccatgtaaatcaattaaattagaacaactctcacatcatgtacagaaataaactcaaaatgatttaaagacctaaaagtaaggcatgacaccataaaactcctgtaaaagaacataggccaaacattctctgacataaattgtagcaatattgtcttaggtcaatctctgaaggccaaagaaataaaagcaaaaacaaacaaattggaggaatgtgaacttaaaaccttttgcattacaaaggaatccatcaacaatatgacaaaacaaactgcagaataggagaaaatatttgcaaaagacatggccaaaaagggcatggtttactaaatatacaaatatagctcataaaactcaacaccaaaacaaaaatctaccctatcaaaaaaatggacggaagaactagtagacatttatccaaagatgtacacgtatgaaaagatgcttaatattactgattgttagagaaatgaaaatcaaaaccacaatgaggtaaaacctcctgtcagaatggctattaacaaaaacacaataaataacaagtgttggataagatgtgcaaaaatagaattttcatgcactgttggtgggaatgtaaatttaagaagccaatatggaagacagtatgaagatatatcaaaatagtacaaatataactgtgttaggggccctaccagaacaaagggaaggcaatgtgcacaatcagcatctgtgcatacatgagcaaatttgtggcagtatgacaatccatatccatgtacaactttgtaatataaaatgtatgttaccttataagggggacaaagggaccaaagtgtaaaagaaaaaaagaattcagggtatataagacagcaccccactgtgtttgggcctcagcctttgatacgcctctgctgagccagtgccagcatgaataaatgatgcttcctggcaaaaaggcctcagtgtcctgtctccctgtatttaagtcctatgatatattttgggggcttttcagggatttggagacagtgatttcacctcccttgtctctgtggtaaaactgctggtatgccgggagaggtgactgcccctggtgccagtggaccaattgatgcttaggggactagccctcctggtgtgccagggagaggaccccgggagcacaacataacctggtgaggcccaggaaccagacaagggagtgctgcccatcagacttgtaagaacctgggttcaatttggtggcctgcccctgaggcagaaagggagcctgattacctcccagagttgcccaagtagtctcacaggagatgaaactgaaactctaaggcactgggagggtgttgcagacattgtatgcatgtgagtgaatgaaacatatgacgggagagttctgattcaaccagaagggccgaaacaagtgttgagtcctgatccgtggtcccatggtgacccttacatggcttatggtggctctcttcagagaggtcctgacattgggatttatacagtcccaccaatgctaagaggaacctgaaatatctcccctgggagagcagccagagacagaagaagtgattgtttactgcttccctttcccttcttgtgtgtgactatcatcttttagggagaggaagtgggtagacaacagaataagcatacccctttagagtgtatgataaaaaattttgagagtggacattcaggagattatagtattcagttgacccctagaaaattccagatgttctgtgtgatagattggtctttgattaccatcagcccctcctggctctgtttaacactgatggagagcatcaaattactcaggcagctctaaaacggctagaggaaaataccccagtgcaaacactagatgcccaggtttatgctcaaaaccatttccccagagaagacccccattgggaccctattgttgaagggggacttctgcaacttaaatgctatcataaggttttcctaaatgacatgaaacaaggtggaaaaagagtcaggaacatgagtaaaacctcagaaatactccaggggcccaacaagagcccaagctaattctatgtgaggcatttcgttgatccagagcagctgaaaaccagtgaatggtcagtgcagcctttgtgagccaagcacaaagggacatccaatgcaaggtccagaagttagagggctttgagggcatgaatcctggtcagttgctgaggatagcaaacaaagtgtttgtcatctttgaccaggttgcactaagggctaaaaacaaaaaatgcaaaaaagagctgagcctactggcagctgccttggtgaagcaaatggaagtcaccacaaagggctgaggctgaggctggggccagaaagggggacaacaaggaagaccatctcacccagggccaaaattaggaccacatcaatgcactcactgccaccaggtatttcactgaaagaacaagtggccgtaattgtcagatgattcccaattgggccccaagcagagggggaagagtctaggtgctccagggccaatatcagctgccgcaacagccacatgtggccccccaaaatgattttgtagaactggccactatgggaaactatgaggaaaactaagacagactgggcaccattctgttaggtccccaagagtctattgtccaaatgaacatagggggctggctgcttgtcttcatggtagatactggggcagaacactcactgataactcagcttatggacccacactcacagaggcaaggggccacaggcaactgaagagagtgcctctttctgttgcctggatggtgcactttggggggacataaagtaattcatgaatttctatacctccccaactgtcctgtggctttgatgggttgggacttattgggaaagctacaggtccagaaaactttcaactcccatggccaaacagccctgacgctagggaagccaagggcagggctcacctgacaaaagcaatattttgtccctcataaagcccagacgggaattcaaagactccaagaaaggctcctaaagtatggaattctccagccttgtcagtcaccttggaacacacctctcctgctggtccaaaagccaagtactgatggttattgactggtctatgttcagtaaataaagccacagtcacgctacatccagtcatcccacacctctatacattctgtgtccatctggcctcccagagtcaattgatttttgccttctagtgggaaaatactgagaatggtgacaagggccaattgacttggaccagattgcctcaagggtccaaccactccccaactatttttgataccacattagcctctgatttaaaggccttcccatgggaccaacatgactgtgtgctactctaatatatggatgactttctgctggcagggtgaacacagaaagaatgcatagatggaacacggcttctccttactctcctgtgggagcctggctaaaaattttcaaggaagaaagcccaaatctgtcaagaaaacatcaacttggtttccacctgtctcagggacaatgtcaacttggcctagagagaaagcaggctgtctgctcaaccctggttccatctacccaacaccaggtctgagaattcctttgggcttcaggtttctgtagaatctggatatccaacttctccactttggaaaagcccctttatgagaccacaaagggggaagaatgagaacctctgttgtagcaatgagtgcaaagccagccctcatcaaggtacctagcctgggactcccagacatctccaagcccttcttcgtgtacatgcatggggtcttaactcagatgctgtggttatgatatcatccagtggcatacttttccaagctaattgactcctttgcccaagggtggccaccttgcctgtaggcacttgcagtcacagctcagtgtcagaagaattgaccatgctacaagaattaacagtccaagtgccacacttggtactaacattaatgaagtattagggacaatattggctgactaatgcctggatggtcaaatgtcagggaatgttatgtgaaaatctgcacattcacctagagttagtaaggaccctaaaccttgcaaacctactacctgttagtccaggccagccagatcatgtggtattaaagtcatggataaattgttctccagtcaacaggatttaagagaccagcccctcaaagacacagatgctgaacttttcactgatggcagcagctttgtaaaagagggaaaatgccttgctgggtattctgtggtgaccctacattctaccactgaagcaaaaactctgccaaaagggacttctgtgcaaaaggcagaactcatcatgctaaattgagccctccaactggcagcaggaatatatgtcaatatatacacagactccaaatatgccgttaccaccctccatgtacatggggctttatataaagaaaagggcctaataaactctggagtaaaggacataaaatatggcaaagaaattcttgaactcttggatgctctgtgggcccctagaaatgtggcagtcatacactgttggggacatcaagggggaaataccatagctgctggggaaaccataaagcagaccaagaggtaaaattcacagattccaaggggacaatagaatcagcagctctgaccaccacactgttccttagactgttggcagaatgggatgcaaactattcacagcatgaaaacacctggttcaaaactaaaaatggaaactacctcccaggtagatggtggaaatttgaagatggctgaattgcaattcctgaggccctagccccagtctttatcaaacaatttcaccaggagactcacatcagccaaatggctcttgagaacacataggagcgacacttctacatccctcatctttccagcatagcccaggtaatatgtgaacaatgtgaaatgtgtgcccaaaataacccatgttcaggaacctatggccgccctggaatacagagtgttggaagggccctgttcaaaaatatagtcatggacttaaccgagcttctctgagtccaaggctataaatatctgttaatcttcatatataccttctcagggtgggtaaagttctcccctactcacacagagaaggcacatgaagtggcctgattcctcataaaggaaattattccccaatctgggataccaatcaccattgtatcagatgatggaccagattttgtggcaggggtaatgcaattggtggcaaaggggttaaaaatcacctggaacttgaacacagcctatcagtccaaaagctctgggaaggtggaatggatgaatcagactctgaaactgcaattaagcaaactgtgtaaggagactcacctatattgggaccagctcttaacaatagccttgctaagaattaggtccagccccactatgcgaacagggttttccccttatgaaatcctctgtggatgtccccctcctctcattaatggtataagggaggacctaaaggaattaggaaatctcaacactgaggttgatacaggcactaggttccaccctggccaccctacatccatgggttagggaacggttacctgtaagcctaaccacagacacccacctcttcaaaccaggggatgatgtatgagtaaaagaatgtaatatccagccattaaaacctctttggaacgggcccatttttttgtcattttatccactcctactgcagtaaatgaggcagaagtgtctcctcagattcaccacagcagagtaaaacctgcttcccaaggctgggaatacacttctgatccaacaacactgtgcaagctgaagatccagaggaaacagattacaaccccagagaccctcaaggactacagccctgctttagtcactccagaaactgactaatctatgcatggaagaagcttgaggaattggctgccagacaggataaatagactgtttttgtttcccatttcagttctctgactgtgatgtactaccaccccttacgcctgcctgttattgtgatcccttcccggatctttgccataggattatcagaggctgctctggccgactgaaaagagtgtgacaacaggcctgggacaatgtcaatgcagacatcaaatggcggaccctaggtggactatactggatatgtgggagaagagcctatactgtacctctcccaagctggtcatgatcttacgtgttggggtccgtccacccatccttcttgctcccacttgccagaggggagcctttgggagttgaagtgtatgaggactgtgagacccatagaaaatggtgtgctctacaaattggcaactgaaaagaggacaaatggcccctgagtgcatatccattactatggtccagccacttgggcagagcatgggtcttacggctactgtactcccatttatatgttaaactgcatcatcaagtttacaggcaactgttaaaaatttgtttgggagatggttttcaactttccagggattcaaatccctcattagcattgtgtttttaattttggggggttgccttatcctaccctgtctagccctcctagttatgaagtctctctccagcctcattgaggtcatggtcaaataaaaacatccacacgtgatgatgctatggaaatataaacccttaaactaagatgatattctttgaccctaaaggggtgtccaagcatcaaaggggggaatgtgataggggtcctcccagaacaaaaagggaaggcaacatgcacaatcagcatttgtgtgtgcgtgcacaactttttggcagtatgatgtaatccatatccatgtgcaactttgtagcatagaccatccaaccagaatgtatgataccttataagggggacaaagggaccaaattataaaagaaaaaaacaatggagggtatataagacagcaccccactgtttttgggcctcagcctttggatatgaatctgctgacagtgccggcatgaggaaatgctgcttcctggcaaaaagtcctcagtgtcctgtctccctgtacctaagtcctgcaacagaaccaccatatggcttagcaattcctctcctgaatatttgcctgaagaaaatgaaaacattaattcaaaaagatatattcatgtctgtgttcacagcagcatcattcacaatagccaacataacaaaacagaaaccaagttatagatacagagaaaaaatagatgattgtgagagggggtaggtggagggaggagagaaataggtgagggagattaagtgggacaaatatttagatgtggcataacagtttaaagatctagagttgtcactgccatggcttgggttgttgctgtggcatagaatcagtccctggcatgggaacttcctgaagctgtggctgaaatgggaagagttacaaatgttcggtttcaaaataaatgggtcaagggtatgacatgcacaatgtggagaatgtagttaatatttactcagtgtcttcataagctctcagattataattgcatttattgtggtggtcattttgaaataaatagaaatattgcctcactccattgtttatcaggaactaacataatgttgctggtcaaatatgcttcaaagaaaaacaaacaaagaaatttatagaaaaaaaattagttcagacttttggttaccagaggtaagaaatgtctggagcagaaattggatgaaaccagtcaaaaagtacaacttttcacttataagacaaataggtgccaaaaatgtatatgtgcaacatgatgaatgtaattaatgctgctgaaagttatatatgaaaattattaagacagtaaatcctaaatgttctcatcacaaggaaatttttttctagtcctttaattttgttatttatatgagacaatctgatccttgacacctggtctcctggacagatataaatctgaattgctgggtgtattttggaagtgcaccagacttgatgaagggaagaatccttatgctgcagtatgctgttttgtgatggtcttctgcatcctctttcattaaaaaaatgccagaattcagttgccatcagattttgatataaaaaaggacttatctgcagaaaaaaatgtaaagaatgattaactcttttatctgaccattaaatcatataaattttcagctgcttttctcttaaaaaattactaattgtattgtgataataatttcatgatttatgtaactaaaatcattatgccgtataccttatacatatacagtgctgtatgttggtcatattacatctcaataaatatggagagggaaaatgaacaactacatgcaaggaaaaagaaactgaaatacattctcagaccatataaaaaatgaacttaaaatcaattaaagacttagatatgacctgaccattatactcctagataaaaacataggcaataagctatttgacatcaatcttagcaaaattttttgcgtgtatctccatatgcaagggcaacaaaaaaagaaattagcaaatgtaactactgcaagataaaaagcttttgtgcaaggaagaaaactattaacaaaatgaaaaggcagcctaatgaataggagaagataatcccaaattatctatctcaagggattaatataaattcatagtacttgacataaaaccccaactaaaaatgggaagaagatcttaatagacattttccaaagaagacgtacagattaccaacagacatataaaaaggtgctccatatctttatcatcaaagaaatcaaatcaaaaccacaattagacatgacctcatacttgtcaaaatagctgttatcaaaataacagcaaagaacaagtgttggcaaagatgtgaaaaaaaagagatcccctgtgattggtttctggaaatgtaaatttgtgcagccactatggaaaacagtatggaggtttgacaaaaaattaaaaaaaaaaaaagagctaccatatgattcagcaattttaattcttggtatttactttaaaatataaatactaatttaaaatttatatgcatgctgatgtttatcgcagcattacttaccatagccaaaatattgaagcaaactataaactcactgatggaagtataaaaaaatatgtgataggagttcccatcttggctcagcagaaatgaatccaactaggaaccatgatgttgtgggtacgattcctggcctcactcagtgggtcaaggatccagtgttgctctgagctgtggtgcagatcacagatgtggctcagatctggcattgctgtggctctggcataggccagcagcaacagctcctattagacccctatcctgggaacatccatatgccacaggtgcagccctaaaaggaaaaaaagacaaaaaaaaaaaaaaagcatgtgtatatatacacatgtatatatgtttgtgtgtttgaacaatgtagaattagagttgatgatcatctgcacatttgaaaatccttgtatcaattacagttggccccccatttaagtggttaccccatatcagtagatttaaccaatggaggattgtgtagtacttcatatttcctgttgaaaaacattcacatataggtggatttgtgctcttcaaatttgtgtcatttaagtgtcaattgtacaaaggaatattacttagacttaaaaaatgaaatcctgcctttgttacaacatggatggatccagagtacattttgctgaatgaaataagtcagaaagagacaaataccatgtgatctcacttatacgtggaatcttaaaaaaaaaaagatgcaatacaaatacaaagcagactcatagatacagaacaaattgtgtttgccagagaagaggtgatgaaataggtgaaaagtattaaaagatacaatccttgagttataaaataaaatgtaacatatagcataagaaatatggtcaataatattataataactttatatggcaacagatgattactgcacttctcatggtgattacttcgtgtttacaaatgtcaaatcactatgtagtacatctgaaatcaacataatatcatctgtcaactatattgcaattcagagaacaccaggcaatatcatgtattgttgaaaatgtgaagaaattaaaacacttaatcattgataatgggaatataaaatggcatacatgctgctaaatttccccccaaattaagcacagaattaccatatgatccagaaaatttatctttaaatatatacctaaaattgaaagcagggactctaatagaaatttgtataccaatgtttatatcagcattattcacaagagccaaaacagggaaaaatgttcactaatgaataaaaggataaacaaaataaggtacatacatacaatggcatgttatttggccttaagaaagaatgaaatttgatacatactacaacctagatacatattcaaaactttgaaataagccagacataaagtgaaaactactgtacgattcaacttacttgataaagctggaatactttatttcgtaaagatggaaagcagagtactggtttcttggactgggaaaggagttatggggtattactgtttaatgagtacagaatttcattttgggatgataaatagcaatggtagcacaactgtgtgaatgaattgttgtatttaattatactcaaatggataaaatgtcatgtatattttatcacaatttaagaaaagaaaaaatttatagagacagggaggaggacaatgatttcctggaactaaggtaactagggtggtagggaggaataggaacaagtgtttgtaaagggacactacagacaaaactttccttaaaaaagacacattcacccgcatgttcattgcagctccattcacaatagacaagacatggaaacaacccaaatgtccatcagcagatgattggattaggaagatgtggtatatatacataatgggatactattcagccataaaaaagaatgagataatgccatttgcagcaacatggatggaactagagactctcatcctgagtgaagtaagtcagaaagagaaagacaaataccgtatgatatcacttatatctggaatctaatacatggcacaaatgaacctttccacagaaaagaaaatgatggacttggagaatagacttgtggttgccaagggggagggggagggagtggggcagttgggggtcttggggttaatagatacaaactattgactttggaatggattagcaatgagatcctgctgtgtaacactgggaactatgtctagtcacttctgatggagcatgataatgtgagaaaattgaaggtgtacatatgtgtaactgggtcatcatgtacagtagaaaaaaaattgtattggggaaataactattaaaaatataaaataaaaaaaaaactataaagggacactatggaacatttaggagtaatgaatatgtcccttaccttgattttggaatctgttccacagttgtaaaagttttctaattagacactttttaaaactttccaaatttgtgtcagctatacttcattaaagctactaaataaacatctttctttttgcagattctgggaagatggcctaaaaacaatgaattgaatatgcattgggaagtacagcagacaatttgaaaacagctggttaaactgcaagagttttggctccatgcacaacaagtgagtgccaaatgcctagttgactgaaattacatgatatgccaggtaaagctacttccaagtcagcatccacattgaggagagtgctgggggaagaaggagaattgaacaaaccaagaaccagaaagacaaagtgaagagtagttctggacaaggaagatatccagaaaacctcagagagcaaatggctatatatattatttaatagaacacatacacaacaagagattggtggcctcaaagattttagaaaagatacattaataaagcatttttccaaaagtttcagaaaagtaagttcagacaacaaccaacaatataaaattttgaagcccaaagtcacacatatttaatatttttaaaacttaacatttctgcaaagaacacaggctgataaaaaagcgccagaaaaagatgaaaactctaggagttcccatcgtgactcagtggttaacaaatatgggtagtgtccatgaaggcacagattcaatctctggccttgctcagtgggttaaggatctagtgttgctgtgaggtgtggtgtaggttgcagacatggcttggatcttgcattgctgtggctaggttgtaggctggcacctacagctctgatttgacccctggcctgggaacctccatatactgtgggtgcagccctaacaagaaaaaaaaaaaaggtgaaaattctaactcaatattttttaagtaagctaaataaacttggaaaacaaataatgcataagtgatagcaattacatcataaatttaaatgggaaataatgtgaaaaaacaaactatataatgataaatgcaataaataataattacagaagtatagattaaagtagaacaagagcaattaacataacaaagagttcattaatataaataggagtttttaaaagcagataattttagaaataaataataatgaagttaaagataaaaacagttttaaaagtgactaatactaaaaataagcatgtaatatttaggacagggataaaatttcccagagaagaaaacaaagacaagaaaagagaacacataataaagattacaattctagaagacattccagaaattaatgaaaaaatttgaatctctacaatgaaatatcatagtatacataaaaattttgagcagaaagaccaaaaaaaagtcaataaaattattgagtttaaagaaaaaaaaatacttttgtacatataagcaaaagatgcatgtaaagattatgaccacaggttttaataacagcactttgagaaaaaacaaaaagtgaagtgacatatttaaaaaacagcaaacatgagttctcatcatggcgcagtggaaacgattctgactaagaaccatcaggttgcaggttcggtccctgcccttgctcagtgggttaaggatccagcattgccatgagctgtggcgtaggttgcagacacggctcggatccagtgttgctgtggctctggcataggctggcagctacagctccgattcgacccctagcctgggaacctccatatgctgcgggagcggcccaagaaatagcaaaaagacaaaaaaaataaaaaaatttaaaaaaataaatattatttgaatatgctttt

SEQ ID NO: 121 - DNA, 7216 bp, Artificial
  ss1036 sequence
tgttccttagttaaaactccatttcacaactagccaagcatggacctggaagatgtagcccataaaagccttgtgaaacccttcttccaggctcagactctggagaaccacctcctctgagcctgccggcataataaacctgagttctccaattctctgagtgctcgcttggtttcttgccgggtaaaagagctgatccactgcagccacagagctgctggagctggtacacgacagccacagggctgtcaccagagctgatacgctgcagcccagggctgctgggtatctgccgtaacatttctggaggccccagcgagattccaaccattctggccccttgagccactggaacagaggtaaggccacccgggaaccagggagcctcaaaccaaacgaggcggcgtgccactcaacggtatcccgggtcctccttcatgagcggcattcctgactccagtgtgactgaaccctgacctgactcagtggagagatggaccaactcaccagaaaggcatccagacaaggtaaggccccagggccaagtccagtcaggtcctgccccagtgggcaaaaaaggggacagatcaccccctgagggagactctcccggtcggaagctgtgcctgaccagtgcagcagtcctagtgctccagattggaagcagaggaacctcttgcttgggtggagcaactgtcgggtgtagctgattgaaagttgtgcttgatcgagctactagttagggactcccagggagtgggaggctttgtgataacctctgagtgtgtgtgagagtgaatgagtggcctgattcgcttgagcttcagattcgagtttgtggctccatggccttagtggctacagagtccaagcaggtcctaacctgcagttccgtggtgacctcatatgggttatggctgtagcagactctgagggttctcttccctccctgcgagtccaatctaagttcagggcttatgcgaaccagccaatttctaagaggcacctaaactcccgaaaggggggtggtcaggtggccaccttctgagaaggaggcacccttctttgttttgtctgcaacactggcacagggtggccacatggggtgggacctaacccagaagcccatgagccagacacccctatgtttctgccattttgggccataaattcctccaaggagatgatctaactggactttgcccctgggcctccaggaactccctgcccagattctaaaccagccatgggactgccagttcatggaagcccaggatctgagtaagggagacaagcctgttatccctgggtcagttcagggtatagggaggattggatacaaggtcccctgtcctttgcccaaaacattagaacttgtctgagagtgccttcctgagactgggggcccatggattggagatacttacaacaaagcaggtgctcttcccagtcatagagcaagctgaatgggatctgtcttgctttcaagagtggtggaggcaaagctattggggataccacccacgaggccagagaaggtctcataatatcaggccatagaaaagatccacataaagacaccatggattcacccaagtctaaacctatggttgtagactgtgtgatcaaagatttcaaaaagggattttttgaagattatggtataaaactaacctgatctttcatcatttcctttgccattacctcaaatagagctgtgggggcaaaggaaacaggcctctagatgataagaccatcctgagttgttaccaggcctgtgggggaaaaggagttaatagctagtattcatccaacttaggccaagtgtttagcctcagagcctcggcatagtcagttttgctttttgctgtttactttcaccctggtcagagtaattgatggctggttcatccaatttacttgttaactgtggcttagaaactttcctaatattaatacaggacatgtcagagtgagcatcttaggattcgaaaactcagggcagggcctgtatgcctgggttttcttcacctctgtccagagacagataatgggcagggatgatgggaagagaggttacgctggtaaagagtggttaattccagtcagcctgaggtcagatgggacatttgtccactagtatctagctgctccatataagagagggcacatcctcacatagccaagaaaggacaacaggtgctggatgctgtttttttctcttttttggataggagccacaccctcaagcctggtgcatggctcaatagcaacttctctgacatgtgccttgagattctgaaaaagaaacatttaattttcttttgaacaaaagcctggccattatataatctgtcagatggacagtgacagccatctgaaggctcactagcttataataccattctccaattatccagaagtttatcagccttctccaatactgctcaaggctcctcctccccccaagcctgtgccaaagttatatctctctctactccctttacaagaagtagcaaacagagaatgggggccaaatacaggtccatacacttatttcacttcaggacttaaggcaaattaaaacagatttgggaaaatttgctgatgacccagatatattgaggtctttcagggtctcatgcagtcctttgagttagcctggaaggacgtcatgttattatgaaaacagacatggactataaggggaaaaaaaataaacaaagtctctaaaactgctcatagctggggaagatgaatggaatgatgctataaatgccagaggcagattagaagaggaatgaacaagattccccacagggtgtcaggcagttcctatgagcaatcccaattggtctgctgatgagggagagaacaacaattggcatagaaatcattttattacttgtatagttgagggattaaaagcctcatgagtaaagcccgttaaaaactatcagaggtttactaggggaacacgagtccatcagctctcttaaaaagactcagccaggcattgagaaaacatacatcagggaacccagaaacaatggcgggctgaataattcttaaggataagttcatagctcaatgggtgccagatatatggagaaagctccaaaaattggcttttggccctgatcaggacttggagcacctcctcagagtagcaactcaagtacgttataatccaggccaggaagaataaaaggagaatgagaggcgagacagagaaaaggctgaggctctagttatggcactacagggagtcaacctgggagtttccaaggtgagaggactagggcagagacctatgcccggagcctgtttcctctgtggaaaagagggaccctttaaatgggaatgccccaagactcagaccacagcacctaggccatgccccatatgttggggagatcactggaagagggactgcccctgaagatgaaggtctctggggttgacccctcaggcccaggatctaggctgagaggacatttctataatggctcctgaccttatcaccactcgggagccctgggtgactctaaatgtaggaagacagcctattgacttcctcctgaacacgggagccacttttcagtcctcctctccaatcctgggcccctccctcatgaatctgccacatttatatttctggcaagctggttacaaaatttcttacacaacctttgagttgtgactgggaatccattttcttctctcatggctttctgattgctccagagagtccaactcctcttttagaaagagatattttgtaagaggttaaagcctcaattcacatggcaatggagcctaatcaaggtttatgcctgccttggatggaagtatataccgacccagaagtctgggccataggaggaaacataggaagagaaaagaatactcaactggtggaaataagtcttaaagaccgcaatttatttctttgccaaaagcagtatcctctgagacccaaggcatgacagggacttatctcaattataggaagcataagagaacagattattaattgaatgtaacagcccttgtaacactcctatattgggagtgcaaaaacttaacagggattggttcctagtacaagacctccatctaataaatgagacactggtctcattacatccagtggtgcccaatctctacactcttctttcacaaattccagaaacagcagcatgggttactgtatcagatttaaaagatgcctttattctgcatttccttgactaaggctttgcatatataaattctcaaaatatggaaggtaactgactgaccagaattaattttaggttccagtaaactgggaaatattcagtattaaattaatatcttaaattagaattgacacacatgtcattagagctgtcaacattaggtttaatattttatcgtacctaggtttaacagaagtcaaaagagacactgagacgtcagttactaaacagaaactaaaggtatttagaataattaatcaatatgatcagtgccaccctgaatggtctccataagaaaaacatgtgtttttagaaattataaagtacagtccatgtttgctttagaaaagtagaatgtgtgtgctttcaatatagaaggaatgagggatggaactgcattttattaaggcaaaagaaagatagtctgtcttcagctgattgctctggttggaaaataagggaaagactaatatggatacagaaagtgatacaaggtgtgtgggaagtggacactgagaagagaattttgtgcatggtggggactgtctatatttgagtaagttaactttaaaagtaatgtggtgccataaatcacactgctcacaaggacataaggtagctttcaattacatgctgaccaaggcatacaagtgtttcataaccagccagagaaatcagaaaaatcatacgttacctgtgctattataaaatctaaatgttgtattcttgattgttcacagaatgtgtctaattccctgctagatcttcaacagtagattcatgagctgtcctatccagatccagcttttggagctgccctgtggaaccagatgacctcctcctcctggtgaaaatatttcttcaccatatccttttattcagaccctgtataattaactgtatttcttgctgcattacatcctgattaaaagctatcaaccttaaaatgttgatagaaggggtacccaaagcaatgtatcaaagcccacttgaccatcccatgaatggagacctaactgctttccctaacgatgccccttttcagcaggaagaagtcagagcagtcatcgcccctttttcccacagttagagtctccaactcgcggcggggattgaggcagaatattaactcaggtagtcagtgtaggaacatgggcttcgatacattctttgatgtggctattggttaacatttgtaaattaagggtctcatagcaactccaactgctataaaggttacaggtattaccccatggatccatcacaccagaataaagaaggctgctaccgccactgacacagacacctgggaagctgtctggcaccctgagaacccctctcatgatcaagttccagagacatttggcaccagaggatggcaggccctgctctggtcacactcagaagctggccagtctatgcatagcagaagcttgaggaatctacagccctgccccagccacatactggaagttggttggtttgtacaagtggaggccagaggatatccatgcaaacttaaactgaactcatgctctggtggggaatattggtaattgaaattgccatagccctcatatttggaatggggctatatgcagtatccccttcagaatggggacagggagcccagctactcatctgtgtgatgtatctcctgtcagtatactagaatccctgttcataatgggtcagtgaaaaggattaagggaatcatagttctgttaacactcaccctgctgctcactccaggggcaacagactgggacgatgacctatgggatgggacaggattaacagatgcttaccagtgtctccctgctaattggacagggacctgcactctagcctttgtcactcctcaaatagatattgtccctgggaatcagtctcttatggtgcccatagaggcacatggcagaacaagacagtaatgcaaattatccccttatttagttggtttgggaatttcagcagggacaggagcaggagtgggaggaatagcatcctccactggttattatcatcaattatctaaagaattcacagatgacttggaacaagtagccccttccctagtagccttacaggattaggtagactctctggcagaagtggcccttcaagacaggagagcaccggacttattcactgctgagagagggggactttgcctgatgaagaattctgtctttatgccagcagatctggaatagtcagaagcatggtccaacaactaaaagaacacatagcaaagagaagggaagaattagataactcctggttaaattggggtaactactggagttgggtggcatggctcatgcctttggatgggcccctcctcatgcttttcatggccttcacatttggcccctgtatcctgaactgtcttgtcaagtttgtctcctcaggcccagaatctataaagctacaaacagtggtggtgtccgggccacacttatatcagcctctgggccaagaagaccaggaagcttgatgcttgctccaagaatgtgaaaaagcatcaagaggggggaatgtaggagaaaatgtcccaataaaatgtagaaaggagagaccccggccatgacgactaagcaaagtctagccaactgccccaaccacccctcccccacacatctgcttctgtaaatttgtttccacatctactaccttgcctgatgtcactccggtccaactagccaagcatggacccggaagatgtagcccataaaagccttgtgaaacccttcttccgggctcagactctggagatccatctcctctgagcccaccggcataataaacctgagttctctgagtgctcgcttggtttcttgccaggtaaaagaactgatccactgcagccacagagctgctggagctggtacacgacagccacagggctgtcaccagagctgatacgctgcagcccagggctgctgggtatctgccgtaacaggacaaga

SEQ ID NO: 122 - DNA, 8885 bp, Artificial
  ss1040 sequence
agagaggtgatgcagggaccgaatgaacctccctcagtttttcttgagaggctcatggaagccttcaggcggttcaccccttttgatcctacctcggaggcccagaaagcctcagtggccctggccttcataggacagtcagccctggatatcggaaagaagcttcagagactggaagggttacaggaggctgagttacgtgatctagtgaaggaggcagagaaagtgtattacaaaagggagacagaagaagaaagggaacaaagaaaagagagagaaagagaggaaagggaggaaagacgtaataaacggcaagagaagaatctgactaagatcttggctgcagtggttgaagggaaaagcaatagggaaagagagagagattttaggaaaattaggtcaggccctagacagtcagggaacctgggcaataggaccccactcgacaaggaccaatgtgcatattgtaaagaaaaaggacactgggcaagggactgccccaagaagggaaacaaaggactgaaggtcttagctctggaagaagataaagactagggaagacggggttcggaccccctccccgagcccagggtaactttaaaggtggaggggcaaccagttgagtttctggttgataccggagcgaaacattcagtgctactacagccattaggaaaactaaaagataaaaaatcctgggtgatgggtgccacagggcaacaacagtatccatggactacccgaagaacagttgacttaggagtgggacgggtaacccactcgtttctggtcatacctgagtgcccagcacccctcttaggtagagacttactgaccaagatgggagcacaaatttcttttgaacaagggaaaccagaagtgtctgcaaataacaaacctatcactgtgttgaccctccaattagatgacgaatatcgactatattctcccctagtaaagcctgatcaaaatatacaattctggttggaacagtttccccaagcctgggcagaaaccgcagggatgggtttggcaaagcaagttcccccacaggttattcaactgaaggccagtgctacaccagtgtcagtcagacagtaccccttgagtaaagaagctcgagaaggaattcggccgcatgttcaaagattaatccaacagggcatcctagttcctgtccaatctccctggaatactcccctgctaccggttagaaagcctgggactaatgactatcgaccagtacaggacttgagagaggtcaataacgggtgcaggatatacacccaacagtcccgaacccttataacctcttgtgtgctctcccaccccaacggagctggtatacagtattggacttaaaggatgccttcttctgcctgagactacatcccactagccaaccactttttgccttcgaatggagagatccaggtgcgggaagaaccaggcagctcacttggacccgactgccccaagggttcaaaaactccccgaccatctttgatgaagccctacacagagacctggccaacttcaggatccaacacccccaggtgaccctcctccagtacgtggatgacctgcttctggcgggagccaccaaacaggactgcttagaaggtacgaaggcactactgctggaattgtctgacctaggctacagagcctccgctaagaaggcccagatttgcaggagagaggtaacatacttggggtacagtttgcggggcgggcagcgatggctgacggaggcacggaagagaactgtagtccagataccggccccaaccacagccaaacaagtgagagagtttttggggacagctggattttgcagactgtggatcccggggtttgcgaccttagcagccccactctacccactaaccaaagaaaaaagggaattctcctgggctcctgagcaccagaaggcatttgatgctatcaaaaaggccctgctgagcgcacctgctctggccctccctgacgtgactaaaccctttaccctttatgtggatgagcgtaagggagtagcccggggagttttaacccaaaccctaggaccatggaggagacctgttgcctacctgtcaaagaagctcgatcctgtagccagtggttggcccgtatgcctgaaggctatcgcagctgtggccatactggtcaaggacgctgacaaattgactttgggacagaatataactgtaatagccccccatgcgttggagaacatcgttcggcagcccccagaccgatggatgaccaacgcccgcatgacccactatcaaagcctgcttctcacagagagggtcacgttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaggatggctggggcggcggtggtggacgggacccacacgatctgggccagcagcctgccggaaggaacttcagcacaaaaggctgagctcatggccctcacgcaagctttgtggctggccgaagggaaatccataaacatttatacagacagcaggtatgcctttgcgactgcacacgtacacggggccatctataagcaaagggtgttgcttacctcagcagggagggaaataaagaacaaagaggaaattctaagcctattagaagccttacatttgccaaaaaggctagctattatacactgtcctggacatcagaaagccaaagatcccatatccagagggaaccagatggctgaccgggttgccaagcaggcagcccagggtgttaaccttctgcctataatagaaacacccaaagccccagaacccggacgaccgtacaccctagaagactggcaagagataaaaaagatagaccagttctctgaaactccggaggggacctgctatacctcagatgggaaggaaatcctgccccacaaagaagggttagaatatgtccaacagatacatcgtctaacccacctaggaactaaacacctgcagcacttggtcagaacatccccttatcatgttctgaggctaccaggagtggctgactcagtggtcaaacattgtgtgccctgccagctggttaatgctaatccttccagaatacctccaggaaagagactaagggggagccacccaggcgcttactgggaagtggacttcactgaggtaaagccagctaaatacggaaacaaatacctattggtttttgtagacaccttttcaggatgggtagaggcttatcctactaagaaagagacttcaaccgtggtggctaagaaaatactggaggaagtttttccaagatttggaatacctaaggtaatagggtcagacaatggtccagctttcgttgcccaggtaagtcagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccctatgaattgctctacgggggaccccccccattggcagaaattgcctttgcacatagtgctgatgtgctgctttcccagtctttgttctctaggctcaaggcgctcgagtgggtgaggcagcgagcgtggaagcagctccgggaggcctactcaggaggagacttgcaagttccacatcgcttccaagttggagattcagtctatgttagacgccaccgtgcaggaaacctcgagactcggtggaagggcccttatctcgtacttttgaccacaccaacggctgtgaaagtcgaaggaatccccacctggatccatgcatcccacgttaagccagcgccacctcccgattcggggtggaaagccgaaaagactgaaaatccccttaagcttcgcctccatcgcgtggttccttactctgtcaataactcctcaagttaatggtaaatgccttgtggacagcctgaactcccataaacccttatctctcacctggttacttactgactccggtacaggtattaatattaacagcactcaaggggaggctcccttagggacctggtggcatgagttatatgtctgccttcgatcagtaatccctggcctcaatgaccaggccacaccccccgatgtactccgtgcttacgggttttatgtttgcccaggacccccaaataatgaagaatattgtggaaatcctcaggatttcttttgcaagcaatggagctgcgtaacttctaatgatgggaattggaaatggccagtctctcagcaagacagagtaagttactcttttgttaacaatcctaccagttataatcaatttaattatggccatgggagatggaaagattggcaacagcgggtacaaaaagatgtacgaaataagcaaataagctgtcattcgttagacctagattacttaaaaataagtttcactgaaaaaggaaaacaagaaaatattcaaaagtgggtaaatggtatgtcttggggaatagtgtactatggaggctctgggagaaagaaaggatctgttctgactattcgcctcagaatagaaactcagatggaacctccggttgctataggaccaaataagggtttggccgaacaaggacctccaatccaagaacagaggccatctcctaacccctctgattacaatacaacctctggatcagtccccactgagcctaacatcactattaaaacaggggcgaaactttttagcctcatccagggagcttttcaagcccttaactccacgactccagaggctacctcttcttgttggctttgcttagcttcgggcccaccttactatgagggaatggctagaggagggaaattcaatgtgacaaaggaacatagagaccaatgtacatggggatcccaaaataagcttacccttactgaggtttctggaaaaggcacctgcatagggagggttcccccatcccaccaacacctttgtaaccacactgaagcctttaatcgaacctctgagagtcagtatctggtacctggttatgacaggtggtgggcatgtaatactggattaaccccttgtgtttccaccttggttttcaaccaaactaaagacttttgctttatggtccaaattgtcccccgggtgtactactatcccgaaaaagcagtccttgatgaatatgactatagatataatcggccaaaaagagagcccatatccctgacactagctgtaatgcttggattgggagtggctgcaggcgtgggaacaggaacggctgccctaatcacaggaccacaacagctggagaaaggacttagtaacctacatcgaattgtaacggaagatctccaagccctagaaaaatctgtcagtaacctggaggaatccctaacctccttatctgaagtggttctacagaacagaagggggttagatctgttatttctaaaagaaggagggttatgtgtagccttaaaagaggaatgctgcttttatgtggatcattcaggagctatcagggactccatgagcaagctcagagaaaggttagaaaaacgtcacaaagaaaaagaggctggccaaggatggtttgagggatggttcaacaagtccccatgggtgaccaccctgctttctgctctaacaggacccctagtaatactgctcctgttgcttacagttgggccttgcttaattaatcggtttgttgcctttgttagagaacaagtgagtgcagttcggatcatggtacttagacagcagtaccaaggccttccaagctaaggagaaactgacctttagccttcctagttctaagattagaactattaacaagagaagaagtggggaatgaaaggatgaaaatgcaacctgactctcccagaacccaggaagttaataagaagctctaaatgccctcgaattccagaccctgttccctataggtaaaagatcatactttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcataagacaaaaagaggagaagtcaatcgcctaaccgaccccagtaagatcgggcgtgccacaaaatgttgaaaatcctgataaatatatcttggtgacaatatgtctcccccacccagagacaggcacaaacatgtaactccagaacaacttaaaattaattggtccacaaagcgcgggctctcgaagttttgaattgactggtttgcgatattttaaaatgattagtttgtaaaagcgcgggctttgttatgaaccccataaaagctgtcccgactccacactcggggccgcagtcctctacccctgcgtggcgtacgactgtgggccccagcgcgctcggaataaaaatcctcttgctgtttgcatcaagaccgcttctcgtgagtgatttggggtgtcgcctcttccgagtcaggacaagagggattttaactcgactggcctttcaagagaagatattctttatgagaaaattgtgctccatttgttttgctgggcatttccaccttggctgtaaatttaaccatcaaaactgctttgaaatatagataaaatgatctctacttaaacaataacaaactcaatggcagtaatttgaagtaatttggaagatgttacctagctgatcagaaacaaagcaggatttaaacctaacattttttctctttccaaacttggactactccctaaaatgtacgtttacataaaataaagcaccattgtttcaaactatctgaaatagtgtaattgcttgtttcttgtttcttcatttataaagaagaaatcaaaagaaaatagaatatctccatggaattttaagcaccttcaggataatctatctataaataaacctaagcaaaacacattattgtgaacttgttgccgaaactcagtctctctccactgggtaccaactagaaatgcagagacaaagttttgtgtgaaggagaaaaaaaaaactttactgctttgccaggcaaaggagggtcacagccagctaatgccctaaagactgtgccccccttgggagagaataggaggtggttttatagtttatagagtttatagagtttataggttttatagtttatagagagtgaaaaatagggccacagaaaaggattagagtagatgcaagctttcatttttttttttttcaaagctggtgatctttctagaatgaagaatgcgtcataaatatcttccatttgttgagggttttagttctgggaagaaatcaaagatattgttatgtatattctcaaagagaaatcaggcccctgccccaaggctgtactattgtgtcttgactgctctcccttgtctctacctccccccccttctctgactagcaactatttaaacctgccctttggaacacagggatggtcatgaaggctgaagcttattccctaaaaataagaaattgtggacacagaaattctgcatgcccaggatacccatggggccctgctcagtttcaaaaagtcacagtatcaaaagaaggactaacatggaaagtctcaaagactaccttgcaaaaaacaaaatagaaatctttccatgttaagaatatccttaaaataacagaaatccccaccccccttcatttctttctctaaaataaagtgataaacagtacatgtacaatacatgtaaagaacatatactctttatcactttattttctaattctggcctaatggaaatttactggcattattatttaagactatagctgaagaatattcattacaaataccaatattttacccaatgctggctgtctgtactagcaagactgtcactgtctagacaatgacactttgataaatcagtattgcattacaacccaatcagaatttatttgaaccactaagctcttcaaaacacagtgattgggagaataaataaggtaggttttttttatattttcctaaagactttcttctttctctttgttgagacggatttttttcaagtctttatattcattatcttaattgtatgaaagcttttgtcactaaccagctaagctttttgcatttttaaatgcttaatagcacttgatgaatgtctaacacatagtgagtaattcctcagggagcaatactttatttcatgtcattgctcagtcttttgtgtcagagaacaaaaagtaataaaagaatttgaaaggaaaataaattaataaaatacaggtttttttttaaaggtctactttttgttgcaaatgacacatctctaagacatttgcctgagacgacaataccatcaggacaagaggtctgtaatatgttttaaattaaaatgaataataaattgtaggcagtcccttttaagaacacttattaaaataaaagaatgtagttagtctatttcatgaagtttgtatttttaaattctctaggagctaagaaatgcttgacatacacctgattgttctgagttaaccacattgatttagcatcagagagcatttaccaatgattatgatgattgtcttaattgaagaccttcagccagtgagtgaatttctcagaaatgttttaggatattaaaaaatcattttcccttttttgttattca

SEQ ID NO: 123 - DNA, 8822 bp, Artificial
  ss1043 sequence
tgaaataagagttttaactaaagaacaaccaacccttggctgaaaaggcagctgcaagcctttccagctatgctcatcactatacgacccttcttgtaataatgtaacaactgtgtgccctatgtccatgccagcagccctgctaatcatgtacccagcattgcttatcagttctgcttctgtaaccttgctttctcagtttcttagggagaaacactgtctgattagggatgcgggggaggtctgatgcttacatgggaaaatcaaggccttgtaatgtataaaagttactgagaacaaagacctggtgctcagactctggaggtgactcttctgagcccacaccggtgctgaataaaccttgcttttccatatctccaagtgctgtttgtctccttccactgccatggtttttgcagtttccgcaacatttttggtgcgttggccaggaagctgacaactgagctggcctcttgtgccactgttgtcagggaaccaagggaggccatggccgctggcctggtgacaggtggatagagcgcaccggccactttgccggatccagactctcactcgggccatgctgccttggctcacaccacttcctgaacggactcagaaggagagtggaaataggttccaggacagggcgtcagactggtgcgtgccccagggacatctgccagagtcaggacccccctatgcagcagaaggagacactgataacctctcagtgaccaaagggtcactcaggttaggatttgttcccttgggatcaggaggcatgtcaattctggtgtgtgtgtgtgtgtgtgtggagagaatgagagcccgtgctccaccatcttcagactacggagacagagtcctaacctgcagttctgcagtgaccctcatacggcttatggtggccctcttcggagggatcctgacgttggggtttatatagtcccacctatgctaagaggcaccttagaggagaggagtctgggggagcggtcaggaggaccaagtgactgttacctggggccttgtcctagctgtttgtcttgcatcaccatcacagggtgggacttcacacaatgggtaaatctgcttccaagaccactgtcttagagtgtatggttaagattcttaaaaaagtattttctagagattatggtattaaacttagtcctggaaaactgtgtaccctctgtaccctagagtggccctcctttggtattggctggcctctggaagggaccttagatgtgtttacaggtggagcagtatataatgttataacaagagaccctggccatgcagaccaatttccatatatttatcaatgattaaaaattgcctatttgaggcccccatgggtttggttctgcaccacaggccagggacagtgtagagtgctagtggcccaatccaaaaagaaaaccttgtctcaaaaaaaggtgccacctatttttcaaggggaacctgaggactcatcccctgtgccacctccttatgtgctgccggctccacctctgggggccgaaggtccccagatgccaggtagcccaccgccttctgtttctcctcctccttctgcttctgaagttcccaaggcaatatcacccccactgccagattcaccagaaccaatgagcaggcatctccgctcagctcagggagcagccactccagcattgcaaatgcccttgtgggagacacggtgaccacggcaagttgcccccaatgggaccatacaagaggggggatgagtttttttattaccagcccttttccactgccgatctcctcaactggaaacaccatactccctcatattctgaaaagcctcaggtgctgattgatctcttagaattcattttccagacacactgtcccacctggatagactgccggcaactcctttttactctgtttgacactgaaacgcactggcaaattgttacagaagcccaaaaatggcttcaggccaatgcggggggtcgagcagacttggcaaactgggtaagggaagtcttcccagaagaaaacccccactgggattatgacactgaagaaggaaaacataacctagagaggtaccagcaggccttcctatagggggcaaaagctggggctaaaaggcctactaatatacttagaccagtgagatactacaagagccaaatgaaagcccagacaaattctatgagagactatgtgaggttttttgggactgcctttgtgggacaagcccaatcagatatccgtaaaaagctgcagaaattagaaggatttgcaggaaagaatgctactgaactgttggaaatagcaacaaggttttattaactgaaaccaggtggcccaccagggtgcaaaaaagagaataaaacaaaaagtgactcttcaggcagccgccctgtcaaaaactgtgcccccagtgggaccaccccataggggacaaggcccaaggccagggaaaaggagtcctctggaacatgacagatgcacttacgcaaagaaaagggacattggaaaaatgaatgccccaacagtcctgagaaaaagaccaacgccccacctagccggtattgatctgagccattcagcatcaacctgattggcctagctgagtctgattataggggaccaggctctctccaactgggcccccaagagcctatggttagaattcaagtagggggccaccccatagactttatggtaaacacaggtgcccaactatctgtggtcatgcaacctgtaactcccctctcagggaaagaaaccaccatcattggggcctcaggtaacccaacccacagacccttctgtggtcctcgatgatgtcaattaggaggccatgaagtaatacatgaatttctttacttgcctgactgcccagtccccctgatgggaagagacctgctggctaaaatgtggacacaaatttccttttctactgatggattggcccaactcaaattgacagaacccccctctcctttaatcatggctcttgctgtaaaaaggggagaggaatggtgcttgtatccttctgcttcagaaatggggaacattccccaagaactagagactaaatacccattggtttgggctgaaggaaacccaccaggactggcaaaaaccatgctcctatcttgattgatctaaaacccagagctcaactggtaaagctatggcaatactcaattcgcagagtagcttgactgggaatccaggttcacctggataggctgcttcagcacagactgttaataaaatgtcagtccccttggaccacccctttactgcccataaaaaaaaaaaacaaaacaaaaccaggaacacaagattaccatccagttcaggacttgagagccataaatgaagcaacagtcacattacaccctgtctgtccctagggtatatcctgttagggttgattccctccactgctgagtggtttacttgcctggacttaaaagatgcctttttctgcctctgggtagcacttgccaatcagcccttgtttgtttttaaaggggaaaatccacatacagggacaaaggaacagctcacctggactacactcccacaaggattcaaaaactctcccactcttttcagcagcaccctagctgctgacctggctgaatttcctggacaaaaactgggctgtgttttgctacagtatattgaagacctcttactagctggcaccacggaggctcagtgcctagagggaacaagagctctcctttctctattaatggaggcagggtatcaggtatcaaagaaaaaggcacaaatctgtaagaaacaagtcaagtatctgggctttaacatcatgcagggctgaggaatgctggggactgaaagaaagcaggcagtttgtgccattcctgtccctaccatcctctggaacgttcgtgagttcctagtggcagcaggattttgccagatatggatccctgggttttcagacttggccaggcctctgtatgaggctccaaaaggggaagaataggctccccttgaatagggaccaagccagaaggcagcattttggacaatcaaaaccaaactcactgaggctccagccttgggacttcctgatgtaaccagagaatttaacctttttgttcatgagaaaaatgggatggctttaggagtcttaactcaagaatttgggccttggcagaggccagtggcatatctgtctaaacaaattgactcagttgcgacctgatggcctccctgcctcctagcgctggcagctaccaccttgttggtgagagaggctgacaagttgactctgggacaaaacctcagtgttaaagtcccacactcagttgtaaccctagtggatactaggggccaccactggctcacacatgcacgaatgactcaatatcaagggttactatgtgaaaatccacgggtaaaactggaggttgcacgaactctgaacccagccacttttctgacagatgaagtggggcccccagaccataactgcttggaggtactagatgaggtgttttccagcaggcctgacttgactgataaaccactccaaaatcctgacctggttttatatactgatggcagctgctttatggaggatggaaaaacaatggcaggatatgctgtggtatctgacttaaaagtgatagaagcagaggtgcttccttaagggtggtcagcacagagaacagttatgggccttaatcagagcattggagctcagctgagaccagtgagttagtacctataccaactcacagtatgcctttacagctttacatgttcacagagccttatataaagaaagaggactcctcactgctaaaggaaaagggattaaaaaccgggctgaaatcttaaagctcctagaggcagtatgggaacctaaagaagttgcagttatccactgtaaaggccatcaaaagggagatgacccagtgacaaaaggaaaccgtagtgctgatacagctgctagacaggcaacctggggaaaatagccagacaaacctaaggtcttgctggccccagaagtgccagctgtccccagatattctccagaggaaaacaatggataagggaggaaggaggaactaaaactaaaatgggatggtgggtcacacgggaccactgagtttatgttcaagaacagctggcctacaaactagtccactaacaacatgagctaactcacatgggcaaaactgccttagagatatttctgggccagtactatctcattgctcatcttcctgcactctgttcctctgtctcccaaagatacataacctgtttacagaataatgcttgccaggggcccaacagaccagctggggcacaacagaccagctggggcacaacactgtggactgtccccatttgaggatatgaaagtggagttcactgaggtcaaccctagtaaggggtacaaatacttactagtttttatgtgtactttttcaggatgggtagaagccttccgcacccgaactgaaaaggcaaggaaaataagcaaggcactcctgagagacattattcccagatatgaaatgtctctgaccattgggtcagataatggaccagtatttgtggccgagacagtacaacaggtggcaaaagcctcacagagccgatgaaaattacattctgcttatcaccctcaaagttcagagaaagtaaaatgcatgaaccagacccttaaacagacattggcaaagttatgtcaggaaactgtcttgccctggatagacatgttgccagtggccctcttgaaagtgagatgctcaccccgagcgggaataggattctcaccatttgaaatcttatatggaaggccaccaccactaatcagtttaaaaggaaacaccagggagttgagagacttggaattacataaacaattacaaggactggggctcactatttctcagatacataaatgggtcacagacagaatacctgtatccttaggtataatagtacacccccacaagccagaggaccaggtgtggataaaggactggaaaaaggagcctttgaggctggtatggaagggcccctatactgtaattctaaccacccccactgctcttaaagtaacaggaatagatgcttggatccatcattccagagttaaaccagctggcccagctgatgactgtggagagtgggagactgccctcaatccagagagacctctatgcctgacaatacagaggaggagacgacagtctcaaagccctgctctgaccacaccggaagctggtcagtcaatgcatggctaaagtttgaggaatcggctgcctggtaaaataaactgacttaatttccacaagagattttcttactcttatacactgttatcttatatccaacatgtatgtttgctgcctgttgctgtcaatctagtcccctttgtttctgccaggatccatttcctcatgtgacccatacattcaagtgacctgatcagatcaaggggttacatggactttgctttactccattcatttctcctgttctggagaaattcaatgaagttgtactcacaacaggaccacttattctatctgtcaacagggggaccaatatatttgctttgatccatgatactcaccgactgagaaatggttagcggtccggcactctcataaataagggcagctaattagttggacccaaattaccaaccccaagttaccagtatcaatactttttgatgcctgtaaaactataaatgggtcatggacttctactataccatgtgaaagcccgtcatggggaaaaaatacagacaccagcataaatatatgtgctggggtactacctggagcaattgccaggaatgcacttactggagctgtgtggcctgggaaacctgggctaagggaaacaaaacagctgtctttcaaaagggtacagcccctccagaccgtcagactaaaacttgtaaccctgttaatctcactattttcaattccagtgagcccaaatggaaggagggtttcaaagtaagcattcgcattgatggaagaggccttaaccctggtgctgtgctacatttccagagaatcatgtttatgctccaagctgcctctcacagggtctttcattccttttatgaagagataaaaaacaccccacctcccattccagccacaactaagaactcgttcttagccctggcagaaactattgcacaaactctcaaggtctcctcttttatgtatacagggaacaaacacaggagaccactggccttggcaagccagagaactgaacccattaaagtcttacaatgagactgcatacccccaattcaccaatggggtatggctcagaacggctattatagggacaaattgtcttgcgaggtggggaggacagttcaatgcttcagttggaagcttaacatgtttaggcctaaagttttataatctgactgcccaaaagactcaatggtggtcatcctccaacctctcagagcccaagcctattcccctgtctaacttttcccacctccgacaggcatgggaagatatcagtgcttggatttgtggaaaaaatggcctattccatactccccccacctgggctggggcatgtgtactgggaacaatcagacctttcttcttcctgctcccattatcactaggggagcaactgggagttccatatatagggcacagggtgcccagagagactggagggctctccaaattggagactggaaagatgatgaatggcccccagaatggataattcaatattatgggcctgccacctgggcagaggatggttcttggggatattgcacccctatctatatgctgaactgcataatcagactacaggcagttttggaacttataacaaatgacactgcaagggccttgattatattggcccaacaacaaactaaaatgtgcagtgcaatctaccaaaatcacttggccttggattatttacttgcttctgaaggaggggtttgtggaaaatttaacttaagtaattgctgtctacaaatagatggcaccagaaaggtgatagaaaaaattgctgaccacatgactaaacttgcccatgtacctgtacaaacttggaaagaatgggatgcagacagtctctttgataaattgttctcttggttggaaaaaattaagacaatgatcggaataatcatggttatactcacagggtgccttacttattccctgccttatacctttcctgataaatattataaaaggttttataagaaccatagttaaaaaaataaaataaaacagcctcccacctgttacttatcagaggctgccaaagggaatgactgatgatgatctctaaagggtgtagatgcaccctaaacataaaaaggggggaatgaaataagagttttaactaaagaacaaccaacccttggctaaaaaggcagctgcaagcctttccagctatgctcatcactatacgacccttcttataatgatgtcacaactgtgtgccctatgtccaagccagcagccctgctaatcatgtacccagcattgcttatcagttctgcttctgtaaccttgctttctcagtttcttagagagaaacgctgtctgtttggggatgggaggaggtctgagatgcttacatgggaaaattaagaacttgtataaaagttactgagagcaaagacctggtgctcagactctggaggtgactcttctgagcccacactggtgctgaataaaccttgcttttccatatctctgaatgctgttttttttcctcccactgccacagtttttgtggtttccgcaaca

SEQ ID NO: 124 - DNA, 8822 bp, Artificial; identical to SEQ ID NO: 123
  ss1042 sequence

SEQ ID NO: 125 - DNA, 4700 bp, Artificial
  ss1068 sequence
aggaagagttaactaaagaaacaacactcccccagattgagggggcagctacatgcctgacagcaggtatgctcaccccataccacccttcttgtaatttgttgcaactacatgccttatatccttgctagcaactctgctagccatgctccaagcattgcttatgagtttcatttttgtaatcttgtttactcagcttcttaggcaggaacaaccatctactaggggaagtagcgggggcgccctgggctgcttgcatgggaaaaacaagacccagaagtctgtattgtataaaagcacctagaacaaaacctggtgctcagactctggaggtgactcttctgagtccccaccagtgctgaataaacctggctattccgcatctctgagtgccgcttgtctctttccgctgccacagtttctgcaacaatttctggcatgttggcatattggccgggaagccgacaaccaagctgggcccttgtgccaccgttgtcagggaattggggaaggccgaggtcaccagcccagtgacaggcagatagcacatgcccggccattttgcaggatcttaactctcacttgggccatcatgacccggctcacaccgcttcccaaagggactcagaaggaagaagggaaacaggttccaggatggggcgccaaactggtaatgccctggggacatttgcgtgagtcaggacccgccatacagcagaaggagagactgatcacttctcagtgaccaaagggtcactcaggataggagttgttcccttgggatcgggtggcctgtcaattctggtgtgtgtgtgtgtgtgtgtgtgtgtgtgtgtgtgtgtgtgtgtgtgtgtgtgagtgactggagagaatgagagcccgtgctccaccgtcttcggactacagagcctcagtgggtcctaagctgcagttccgtggtgacctcataaagctttaaggctgtgccaggctctgagggttctcttccctccctgtgagactggtctgggtccggggcttatacggaccagcaacacgccaagaagcacttaaacctctgagagggggtgatcaggcggacgaaagtaagtgcgccccctactgtttgtcttttgacatgggcacagggtgggaattcacacaatgggaaaatcggcttagacacccactgtcttagaatgtatggtaaaaaattttaagaaaggattctctggagattatggtgtagaactgagatctggaaaactgagcaccctgtaccctagagtggccctcagtacaggtcagctggccctcggaagggaccttagttgtgcccaagatttgagcagtatataatgttataacaggagagcctgaacacccagaccaatttccatacattgataaatggttagaagttgcccatgtaaggcctccttgggtttggttctgcttctcaggccagggacagtgtaaggtcctcgtagctcagtccaagaagaaaactctgcctcgagaaaaggagccacctatttttcaaggagaggtcgaggactcgccccctgtgccacctccttatgtgctactggcccctcctttgggggccaaagctccccagctgccagacagcccaccaccttctgtctctcctcctcctcttcccaaggtccccaaggcaatatcgcccccatggccagattcaccagaaccggtgagtgagcaggtgtctctggttggcccaggaagcagctggcccaacgctacaaatgctcttacaggagacacggggaccgcagcataatgccctcgatggaaccatacaagggggggatccatcttttactaccagcctttttccacaacagacctcctcagctggaagcatcacactccctcatactctggaaagtctcaggcactgatcaacctcttagaatccattttccaaacacaccgccccaactggcagttgtttaaaccaaagagtgccaccgaattgtcacagaagcccagaaatggctctagaccaatgccacagggcatcaactggacgtggaaaactgggccaggcaaggcttcccagaggaagggcctcgctgggactacaacaccgaagggggaagaaagaatttggagagataccgactggcggcagccctgtcgaaaccaggacctccagtgggaccaccctgtcattcaaggggcccaaggccaggaaaaaggagcccctcagacacgatccatgtgcctactgtaaagagaagggagattggaaaaatgaatgccccaactgtcctaagagaaggacaaaatcagcacccccacctagctggtaccaacctgagccatccatctagcacgaatctgattggctgagtcaaagcagaatccaactgggggggaccaggctctctccaactaggcccccaggagcctatggtcagaattcaagaagggcaccagcctatagacttgatggtagatacaggtgctgaattcagtggtcacgcaacccaaggctcccccctcgagaagagaaactaccatcattggagccagaggcacccaaacccgaaggcccttctgcagtccccatcagtgctggttaggaggccatgaggtagtacatgaatttctttacctgcctgactgcccagttcccttgatgggaagagaccagctggccaagatgggggctcaaatctccttctctgccaatggatcagctcaactcaaattaacagaactgccctctctcttaatcatggcgcttgctgaaaggagggaagaagaatgcacctgtacacttcccctccagaagaggggaccattcccctggaactagagactgtgtacccattggtttgggccaaaagaaaccctgtaggactagcaaggcaccacgctcctgtcttgactgatctgaaacctggagttcaatgtcaaagccgcagcagtacttgatttccagagaagctcgagtgagaatccaggctcatctggacagaatacttgagcacagactgttgataaaatgtcagtcgccctggaacacccccttattgcctataaagaaactggggacacaagactaccacccagttcaggacctaagagccataaaagaggcaacaatcacggtgcacccgtcagaacctaacccatacaccctgctggggcagatcccttccactgccgagtggttcacttgcctggacttaagacatgccttcttctgcctctgagtggtgcctgctggtcagcctctgtttgcctttgaaagggaaagtccacacactgggacaaaggagcagctcacttggacaagactcccacaaggattcaagaactaggatctacttttctcagcggcgccctggcctctgacctggctgaatttcctggacaaaaaccagactgtgtcttactgcagtatgttgatgacctcttactgcccagcaccatgcaggctcaatgcccagagggaccaaaagctctcctctccctcctaatggaggctgagtatcaagtaaaaaggcacaaatctgtaagaaacaagtcaagtatctgggatttaacatcattcgttggccctgcatgatgttaaatcccacgatctcaaagccctgctccaaccactctggaagctggtcagtcaatgtatggctgaagcttgaggaattggctgccgggtgatgtctgttgtttgctgttattaacctggtcccccttgaccctgtcaggatccattctgatgggtgcagatgcaccctgaacatcaagggggggggaatgaagtaagggttttaactaaagaaacaactttcccctaagccgagcaggcagctacatgcctgacagcagctttgctcaccccataccacccttcttgtcatcttgtagcaactaggtccatgtccttgctagcagctctactagccatgctgcaagtattgcttatcagtttcatttctgaaatcttgtttactcagcttcttaggcaggaacactgcttggggaagggggtgcgccttgggctgcttgcatgggaaaaacaaaacctagaggtctgtattgtataaacgcatccagaataaaacctgctgctcagactccggaggcaactcctctgagcctgcactgatgctgaataaacctggctattccacatctctgactgctgcttgtctctttctgctgccatggtttctgcaacatgttactgtccaacttgtaattggacttaggcttttgcttccagttcccatacctacttattagttttctgactgtgtcagagctgtcctagggtcccctgctgttctattgaacaagatttagaagcaggttgactcacccttctccagctataacaaaggaactatctgggaggtgggccttagacagtatattcagacctcaactaacagaatcagaatttgatatccattgaaatggtctctttctctctaaaagtaccctcattttaaaatcaaatacagccaagttaagattagtttgttttcaaagttactccagtgaattgatcataatttgttcctttaaattggttgtgcggaattttttcataagaaatctcagactgagatttcataaagcctctcagggccaggacagccctgccaaggaagtgtcagacttcaccttacaggtttgtgtgaatgcctccctttctgaggtccccaaaataccctgag

SEQ ID NO: 126 - DNA, 5287 bp, Artificial
  ss1069 sequence
tacacacacacactccacaaacacacacacacaccccgccccaggctgcagaggcagctacatgcctaacagcagttttgctcgccccttaccacccttcttgtaattttgtagcaactacttgccttatgtccttcctagcaactctgctagcctgtgggctccaagcattgcttatcagttttgtgtttgtaatcttgtttactcagcttcttagataggaacacagtctgctcctggaaaggggagggccgggctgcttgcccaggaaaaacaagacccagaagtctgtattgtataaaagcacccagaacaaaacctggtgctcagactctggaggcgactcctctgagcccccaccagtgctgaataaacctggctatttcgcatctctcagtgccgcttgtctctttccgctgccacagttttctgcaacaatttctggcatgttggcatattggccgggaagccaacaaccaagctgggcccttgtgccaccgttgtcagggaattggggaaggctgaggtcgccggcccagtgacaggcagatagcacatgcccggccgttttgcaggatcttaactctcacttgggccatcccgacccggctcacaccgcttcccaaagggactcagaaggaagaagagaaacaggttccaggatgggacgccagactggtaagtgccctggggacatttgcgcgagtcagaacccgccatacagcagaaggagagactgatcacttctcagtgaccaaagggtcactcaggacaggagttgtttccttgggatcgggtggtctgtcaattctggtgtgggtgggtgggtgggtgggggtgtgtgtgtgtgtgtgtgtgtgtgtgactggagagatgagagcccgtgatcgggtggtctgtcaattctggtgtggtggtggttgggtgggtgtgtgtgtgtgtgtgtgtgtgtgactgagagaaatgagagcccgtgctccaccgtcttcagactacagagcctcagtgggtcctaagctgcagttccgtggtgacctcataaagctttaaggctgtgccaggctctgagggttctcttccctccctgtgagactggtctgggtccggggcttatatggaccagcaacatgccaagaagcacttaaacctctgagggggggcgatcaggcggacgaaagtgagtgcgccccctactgtttgtcttttgacatgggcacagggtgggaattcacacaatgggaaaatcggcttagacacccactgtcttagaatgtatggttaaaaattttaagaaagattctctggagattatggtgtagaactgagttctggaaatctgaacaccctgtaccttagagtggccctcggaagaggtcagatggccctaggaagggaccttagatgtgtccaacattcaagcagtatataatgttataacaggagagcctggacacccagaccgatttccgtacatcaattaatggttggaagttgcccagttaaggcaaccttgggttctattctgcatcacaaaccaaggacagtgcaaggtcctagtagctcagtccaaaaagaaaactctgcttcgagaaaaggacccggggagagtcttgggactcgccccctgtgccacctccctatgtggtacccgcctctcctttgggagccgaagctccccagctgccatacagcccaccaccttctgtcgctcctcctcctcccaaagtccccaaggcaagattgtccccacagcaggattcactggaaacagtaggcaggcatctctgatcagcccagggagcagctgccccagtgcttcaaatccccttaccggaggcacggggaccaaaatgtatcgccccggattggaccatataagaagggggaccagttttctacgaccagcccttttccacgacaaacttcctcaactggaagcatcatactctgaaaagcctcaggtgccgacagacctgttagaatccattttccagacacactgccccacctggagagactgtctgcagctccttctcaagttgttaaagaagagtgatgccgagaaattgaaacgggaagccgggaaatggctctagaccaatgcccccagggcatcaactggtcgtggaaaactgggacaggcaaggcttcctggaggaagggcctcgctgggactacaacaccgaagggggaagaaataatttggagcgataccgacaggccctcctgcagagggtaaaagctggggctaaaaagcctactcgcatggccaagccccctgaggggttgcaaaagccggatgaaagcccggccgacttctatgagacactatgtgaggcttttcagatcttcgccccttatgatcctgatgcctctgagaaccaatggatgataaatgctgcctttgtgggacaagcccaattggacatcataaaaagttacagaaatgagaaggatttgcaagaaaaaaaatgccacagaattactagaaatagccaacaaagttttcattaaccgtgaccaggtggcccaccgtgatacagaagggaatgaaagaaaaagctgcatttctggcggcagccctgtcgaaaccggtacctccagcgggaccaccccatcagtcaagaggcccaaggccaggaaaaaggagctccctcggacacgatccatgtgcctactgtaaagagaagggagactggaaaaatgaatgccccaactgtcctaagagaaggacaaaagcggcacccccacctagctggtaccaaaccaggccatccatccagtgcgaatctgattgactgagttgaagcagaatccaactgggggggactaggctctctccaactaggcccccaggagcctacggtcagaacttaagtagggggctgtcccataggctttatggaagatacaagtgctgaacattagtggtcatgcaacccatggcttcgctctcagggagaggaactaccattaccagggccacaggcacccaaaccggcaggcccttctgtggtccccaacggtgccggttaggaggccatgaactagtacatgaatttctttacctgcctgaccacccagttcccttgatgggaagagaattgttggccaagatgagggttcaaatctccttctctgctgttgaaacctggagctcaacctgtaaagctgtggcagtacccgattcccagagaagctcaacctggaatccaggctcaactggacaggctacttgagcatggactttttgataaagtgtcagtcaccctggagtaccgcttatgcctagaaagaaactgggggagttcccacagtggtgcagtggttagtgaatccaaataggaaccatgaggttgcaggttcgatccctggccttgctgagtgggttaaggatccggcgttgccatgagctgtggtgtaggttgcagacacggctcggatcccgagttgctgtggctctgcagtaggctggcagctatagctccgattggacccctagcctgggaacctccgtatgccacgggagtggcccaagaaatggcaaaaagacaaaagaaactggggacacaagactaccacctggttcaggacctaagggccataaatgaggcaacaatcatggtgcacccgtcagaacctaacccatacaccctgctggggcggatcccttccactgccgagtggttcacttgcctggacttaagacatgccttcttctgcctctgagtgctgcctgctggtcagcccctgtttgcctttgaaagggaaaatccacacactgggacaaaggagcagctcacttggacaagactcccacaaggattcaagaactaggatctacttttctcagtggcaccctggcctctgacctggctgaatttcctggacaaaaaccagactgtgtcttgctgcagtatgttgatgacctcttactgcccagcaccacgcaggctcaatgcccagagggaccaaaagctctcctctccctcctaatggaggctgggtatcaagtaaaaaggcacaaatctgtaagaaacaagtcaagtatctgggatttaacatcagcggggccaacgaatgttaacgactaaaagaaaacacactgtttgtgccattcctgttcctaccacccaccagaaggtaaccaaggcactcctgagagacatcattcccagattcggaatgcctctgaccatcgggtcagacaacagactggcatctgtggccaagacagtacagcaggtggcgaaaatattacagagccgatggaagctacattcagcctatcgccctcaaagctcagggaaagcagaacgcatgaaacactggaagctggtcagtcaacacaggctgaagcttgaggaatcggctgcagggtgatgtttgttgtttgctgttgttaatctggtccccctgatcctgtcaggatccattccagcaggtgcacatgcaccctgaacatcaagagaggggaatgaaataagagcttttaactagagactagagaaacacacacacacacccccaccccaccccactgaggaggcagctacatgcctgacagcagcttggttgcccataccacccctcttgtcattttgtatcaactatgtgccttatgtccctgctagcagctctgctagcagtgccccaagcactgcttatcagtttcatttttgaaatcttgtttactcagcttcttaggcaggaacactctctgctctgcgaagggggtgtaggggcgctgcttgcaaaggaaaaacaagactcaggagtctgtattgtataaaagcttcccagaacaaagacgcagtgctcaaattctggaggcgactcctctgagcccacaccggtgctgaataaacctggctattctgcatgtctgagtgctgcttgtctctttccactgccacggtttctacgggttgagtttatactataaactcacacatttaacctgagtgttatataagtaaggaagtatggtcaggcatgagatgacactgtgtgatcattcctattaacaaaataaggcatatctcaatatttaacctttataaaaactatttcaagtgattttattatacatatatatatatatatatatatatatatatatattctgtagcctttgtagtcatttgaacatggcagcccatctcttaaaattgctgatgaataatgaaaacattcaagaagtattagcaaacttcaaactcttgtaagttttcagaaacattagtaatttgcactatttacaatagtaaatagccaacacacagaa

SEQ ID NO: 127 - DNA, 5808 bp, Artificial
  ss998 sequence
ttaaatgtaaaatattgtaagcaagcaaccattagtggtcctgttaagctgttggtcagcattgtaataagcccttcccccaagcaagtgacagtaagtgagtggccactggcccctccccctcccctttctcagtgtgaaaagagcctgaattcggactgaggcaagataattttttgagacactagtctaccatcttcttagtctgcaagttttccaattaaagtcggtatccttgccccaacaactcatctccaaatttattggcctgtcatgcagcgagcagagtaaacttggattcagtaacaattttggcgagccagccaggagtcttgctatttgtgaccagccggccccagttggggaattttctggtaagttcctagcagcagccagggccacttgtcctgaatatcttcccttaaaaattcactgaagtggcaccagctgccccattgcttggcagttggagcaaggaatcaacatttggaagctgatgggctccatacagtagaataggtagctccagtgtgtacaatcaggaacattctcccctctcaatttgggcttttcctttaagtgaaaagtcactttgttttgcctttgactggggtaccctgttggagaggggaactgttgttggaccctacctaatttgatttgtgaacttgtgcatttgcttttgttttgcattcatccatgatggaatctgtttgttcctttggtattggaatttgtttgtgctttttgtgttttgttgttcttagacttataaatatgggaaatactccaactacccctaaggaaagccctttggggcatatattaaataattgggcaaaatataactgtgggcatatgaataagaaagagatggtactccactgcaataacgtgtggtcccaacatgtactaggctcaggagagaaatggccgttgaatggcttacttatacaatcttgcaattagagttgttttatgaaagagcaggtaaaaaaatatgtgattctctatgtagaagcatttatgatattgcatcaggaagaacagaagtcagacagctgttgccttatattacagcagtgtgaaaggaaaactaagggaaaacctgttccacaagagggaggggagaaaatgagagtgaggacatgctacttcaaaccttaagaccaccttccagccaacctgcctcccccattagctgaccaagctgcacaagcagttgtttcaactgctcccatgctgccagcatatttaccctctcttgtttccccttctatggggatcagttagaaggttctatgttaaccccaagaacacaggagcctggtttggtatcaccatctaagacccggcagggcactcaatttggaccaggagccacttccacagcaagacagtttcccttatgccaatatcccataagaggccttaatgaaaatggccaaccagctgggtttctgtggatgcaaccccaggtaactgtgacagtaagggaccagttgattgactttcttatagatatgggtgtaacttactctgtggtaaacaccaagttggcccagaaaacgtcctaatccattccagtaatgggagtttctggagaagtacaaacttgttctttctttacaacctctagaatgccaatgaggggccctcactctgaaacacagtttcttatatatgctagcgtgtccaatccctcttctgggctgagatctcctttgtaaattaaatgctcaagtaactttttgccggaagagcttgacatcagagtcccaatggagcatgatttgagcctacagatggcactcatggatgccccagaaaaggaggcagagctctttccccagaggtctacaaagaggtaaggccagaagtgtgggctgatggcaccccaggaaaggccaaatgccaggccaataaaaattccattaaaaagggatgatgggacatctaatctaaaacaatattctctgaggcaagaggcccaaagggaattcagccaattctcaaaaatttttttggaaacagatttgattaaagcttgcaaatcccagtataacacccctattctcctggtaaaaaagccaaactcagcagagtatcattttgtccaagacttgagggctattaataaatagtctaagatttgcaccctgtggtacctaatccatacactttactcacaactattctgggagaatacagctgtttctcagtttcagacttgaaagatttcttttctgaatccctattgcagaagaatacagcagctatttgcctttgaatggcaggacccagaaacacaggtagtccaacagtattgttggacagtcctgcctctaggatttaagaattcccctaccttgtttggggaaatgatgaccaagggccttagaaacttaatattggacaaaggacccttacgccaatgtatggatgatttactcatagcaagccctacatataagtgtctacaaaataccatcagaaccctgaactatttgaccacttgtggatataaggtcccccagaaaaaggcccaagtgtgtaagcaacaagtcacatatttgggttttgccatttcgcaaggacagcggagtcttttgtctgatagaaacacataactgcaggcttgggaacacccaagattcacggacaactgagagggtttctgggaatggcaggattttgtcggatttggattccaaactatgcgctcataattaagtccctctctgaggctttaaaagggcgtgatcttgagccccttatgtagactaaagagtgccaaagagccacttaggtaataaagacaaagttagtctctgccccagctttgaggctactggacttaaagaaacctttcaaattgtatgtctatgagagacagggcataagtcttggggtatgaattcagtatctggtgaatatccttcaacccattgcctacttctaaaaacagctagaatggacagttaagggatggcccccttgactttgagctgtagcagctacacataacctacaggtttaccctgggttgtatgtatgtctatgtatgtctctcaccgtgtccttttttttattggaccaaaatgggtgctattggctgatttccaggaagatggaaaagtaccaagccatcttagacaatcataacctaagactgcaagcacttcagcactgaatctagccacattgctcccaactgacactgcgcaatccccagagcacgactgcctccgtatcattgagctggtgtactctagcagactggacttgatggaccagcccttggctgagccagttatggaacagttcactgagggaagcagcttcatggaccaaggtaggcattgtgctgggtatgtggtagtaagccttaaaaattttgttgaagcaaaagccctgcccccagagagctcagctcagaaggcagagatgatggctctgacaagagccctactgctcactgaagggaaacccataaatatacacacagactctcactacgcagtctctgtggtcacggtaatggggcaatctggcaagaaagggggctcctcacttcaaacaataaagacataaaacatgcttctgaaatcctgtcgcaattagaagcattccataagacctcatgagtggtcataatgcactgcccaagtcaccgaaagggttaaactcgtataataaaaggtaaccaaatagctaaccaagctgcaaaaaaggcagcgaaggaaggtgattatcaagacacaatagggtcacttctcccacagactgacttgtcataataccagccagtatattcagaaaaggacaaggagagggccaaatagtggggattcattcttgatcataccttgcctggctggaaatgtagcgcacaagcaattgttttaatccctgatgccctcttggaccctatgctatagcacgttcataatactacacattacaggagggatgctgccttgcaatggatttgaaaatatataatggggcctaacctacaaaggccatctaaaccacatgatttgtgctaaaaataatccaaagactgctgtgaggcctccacagatggggacccaaaatggaggaatctgccccttggaagactggcaaatagactttacccaaatgcctcgggctgcaggaaatttcagatacctgctagtatttgtggatactttttcagaaggaatggacccatatcctaccagcaaagaaaaagcccccaaaggggttaaagccctccttaaggaggttttcccccagtttggaccacctaactgccttcaaagtgataatggacctgcttttgtctctagcataacctaacaagtatctagagcactgcaaattaattggaagctacattcatcctgaagactacaatcaacaggaaagactgagaaaatgaatcctacattaaagaggagcattgctaaaatatgtcaagagactaacctgggataaggtcttagcagtgccctgctactggttagagtggctcccagaaggaggtttaaattgaacccctttgaaatattgtatgataggccacttcaggtgtctacttgggcaggggaatctataaatgctctgaaagatcttgtagttgccaattatgttagaactctgggcactatactaacctctttcatgagtttgcttccaacaggtctgcctatccaactgaggtaactttatatcctttctgacttggagatcaagtcctccttaaaatctggagagaagaagggcctgagtaccaactgagtgcaaggtggacgggaccacgtgtagtattacttacgatgcacccatctgttgttacctggagtaaagccatggattcatcacacttggggtaaagtagccccaatgacaccagaaagtgacccaactactgagaggcctagagagcaatgggtttgggaatccttagaagacataaggttgctctttaaaaaggataagtattgagatcagaatttcattgtagcaggaattttaccaagtttaaatagttgtagataaagaaagagaaatgtattacttaatattcccagcataaggctcatcaactccatttcatgctcacccccccttgcccatgttaagcaagaagtagccagaaagatcattgccccttttcccacaagattgtgaaatagacactgacagtggaagttgtaagtgaacaaccattagtgagcaacacttagtggtcctgttcagccattggtcagcattgtagtgagcccttcctccaagaaagtgacagtgagtgaccattggccctttcccctcccccttctcagtataaaaatagcctgaattcagactgaggcaagataattttttgagacattattctgccatcttctcagtctgctagctttccaattaaagtcactattccttgccccaaaaactcatctccgaatttgttggcctgtcatgtggcaagcagagcaaatttgggttcaatacaatatgatatcaaaaacagtagtcaagaaagaggagtacaaatgcagggtttttgaactgcatctgaaactaagagatcagcaagttaaaacaatcatacacacacacaaacatatatatacatatatacatatacacatacatacacacatatatatcatcatactcaagggtggaaaaactgaaagcatttcctctaatatcaggaacaaggcaagtatgcccactcttgcaacttttattcaacatggttttggaagttcctaaccatggtaatcagagaagaaaaagaaataaaggaat

SEQ ID NO: 128 - DNA, 12429 bp, Artificial
  ss999 sequence
  misc_feature (8054)..(8153): n is a, c, g, or t
atccaatttaccggttaactgtggctttgtagctttcctaatattaacagagggcatgtcagagcaagcatcttaggatttcaaagctcagggcagggactctatgcctgggttttcttcacctctgtcgcgagacagacaatgggcagggacaatgggagaagaggctacgctggtaatgagtggttaattccagtcagcctaaggttggatggaacatttgaccactaatgtctagatgctctgtacaagagaggggacgccctcacacaactgagaaaggacaataggtgctggacgccattcttttctctttctcagatgggagccacatcctcaagcctagtgcatggctcaatagcaactcccctgacatgtgccttgaagaactgggaaaagtttgatcctcaaactctgagaaagaaatgcgtaggttttttttttttttttgcacgaaagcctggccactatataacctgttggacggggaatgatggccatctgaaggctctctagattataatactattctccaattagacctattttgtagatgagaagggaaatggtgagagatgccttttgttcagatgatctttacaatgagggaagatactaaactgaggaaggcttgtggacttccccagtgcattacaccaactccctcaggagctaggtgcccaccatatcctggcccaactgggtcagaccttcccaaagttaatcagccttcttcaacactgcccagggctcctcctctcccccctccagtgccaaagttatatccctctttactccctttgcaagaggtagcaaatggaaaatagggaccagtatgggtccatggccttttctgcttcaggacttaaggcagataaaaacagatttgggaaaatttgcggatgacccagacagatatatcgaggtctttcagggtctcatgcagtcctctgagttagcctggaaggacatcatgttcttactaaaccagacattgactataagtgaaaaaaataaagtcttagaaaatgctcaaggctagggagatgagtggtatgctataaatgccagaggcagatcagagaggaatgaacaagattccccataagggtgtcaggtggttcttacgagtgatcctaattgttctactgataagggggataaagacaattggcacagaaatcatatttattacttttatagttgaggtactataagctgcatgagtaaagcctgttaactactccaaactattggaggtttgtcaaggggaaagagagagctttcttagaaagactcagagaggcattgagaaagcattcaccaatggacccagaatcaacagagggccaaataattcttaaagacaaatttataactcagttggctccagatatacagagaaagctctaaaaattaccttttaccccgacctggagcaccttcttagagtagcaactcaagtatattataatcaggaccaggaagaacaggaggacaaaaggagagacagagaaaaggctgaggctctagttatggcactacagggaataaacttgggagtttccaaggcgagaggactagggcagagacctaagcctggagcctgtttcctctgtggaaaagagagatactttaaatgggaatgccccaaagctcaggctaagcacctaggccacgtcccacatgtcagggaaatcactggaagagggactgaccctgaagacagaggtccctggggttgaccccttagttcccaggatcaagactgacaggacccagggcttttcatattcgttcctgtccttatcaccactcgggagctcaggtgactacagatgtaggaggacagcttattgacttcctcctggatacaggagccgccttttccgtcctcctcaaccctgggcccccttcaaataaatgtgccactattcgtggtatttctggcaagctggttacaaaattctttacacaacctttgagttgtaactgggagtccattttcttttctcatgcttttctgatagttctggagtccaactccacttttaggaagagataccttgtcaaaggttaatgcctcaattcacatgacaatggagcctaatcaaggtttatgcctccctttgatggaagtattgacccagatgtctgggccataggaggaaagataggaagagtgaaaaatgttcaactggtgccagtaactcttaaagatcaaaatttatttctttgccaaaagcactatcttctgagacccgaggcacaacagggacttatcccaattataagaaacctaaaagaacagggactattaatcgaatgcaacagcccttgtaacacccctatatcgggagtgcaaaagcctaacagggattggtgcttcatgcaagaccttcatctggtaaatgaagcagtagtcctattaccaacagtggtgcccaacccctactctctcctctcacaaattctagaaataacagcctggtttactgcattagatttaaaagatgactttttcttcattcccttggctcagacttcacgatttatatttgcttttgaggacccctcatacttgtccacatgatgaacttggactgtcttgcctcaagggtttagaggcagtcctcatttttttggataagaaaaaaatgcatttttataaattataaaagacagtccatggttgctttagaaaagtagaatgtgtgtgctttcagtaaagaaggaatgaggaatggaattgcattttattaagggaaaagaaagatagtctatctttagcttgttgctctggatggaaaaataacgggcagactaatatggatacagaaagtgatgcaaggtgtgtgggaagtggatactgagaaaagattttgtgcatggtggggactaagtttagaataaatttaattttaaaagtaaggtggtgccataaatcacattcctcacaaagacaaggtaactttctattatagacagaccaaggaaacagcataaaaaatttttcatgaccggctggagaaatcagaaaaatcataccggttaaaggtattttaatcaatttaatcaaatataggatcaatatatgtggatcactcctgaaaagggttatttaacccagcccgcatctaattgctgggagcaaaataaatattatgttggatttggggggcaacacctatccgctaatgagctaaaacctttaggacatttagcaactaaacattgtttacaaatcactcaggtcacatacagtccagatatgattcccgcaaggcctggaatcgactggggatttaatcttggagtaagttgcctatccctgaatgaaatttattaattatgtggaactaatctgtggccttggctgcccccaggatgggtagggcgatgtactctgggattggcttttattcatggcaacattatgaaaactctgagctgagcaccagccaaccttccctatttacatgctagatgggccagatcagtgttctactggtatgattacttaacagcgatagttgtgccttcattgagaaccactgacataatgctgtgggtggaagccttaactaactttattcaagctcttaatgatactgcagaactatttctaccctaaatatggaacaacgacaaataagaaaagtagtgctacaaaaccaaatggctttagatatgctcactgcagctcaaagaggtacctgtacattataaaatgtaaatgttgtgcctatattcctgattattcacagaatgtgtctgattttctgctagatatccagcagcagattcatgagatgtccgatccagctccagcttttggagctgccctctggaactggttgacctcctccccttgggggaaatatttcctcaccagagtcattgttgtgaactcgatccttttatttggaccctgtgtaattaattgtacttctcgcttcattacatcccaattaaaagctatcaaccttcaaatggtgatagaagggatacccaatggcatgtattgaagcccacttgaccatcccatgagcggagacctaactgctttcccctaatgacgccccttttcagcaggaagcagtcagagtggttgtcactccttttctccccacagtcagagtttctaactctagaagcggggattgaggcagaataataactcaggtagtcagtgtaggagcatgggctttgatgcattctttgatatggctattgattaacatttgtggcttaagggctcagggagtaacatccccacaggccttgtttactaggaagtgtacctacgcccaggtggacattaatccctatccccttgtgactcagtttacgtgaagaaagtttatgggaagaagtttatggcaaagaaaccatgaaacttacaggacatttccacccttaaagcactattggataagaaaggatataggtaattgagcaaggccaatgggagaaaaccacatctttctggaccccaccctggtaccccccatctttaatggataaaaaattctacaggacaacagagagtggggggctcttcttccccttccagcagccctgggagctacttgctttcttgtaatactgtgcttgcttgcaaataaataaataaataataaaataaaataaaaaacttccagcaaacaaaagtccaggaccagatgtcttcacaggtgaattctatcaagcatttggagaagagttaacacctatccttctgaaactattccaaaatgttacagaggaaggaacattcccaaactcattctatgaggtcaccatcactatgataccaaactacacaaagataccaaaaataggaatattacaggccgataacacagatgcaaaaatcctcaacaaagtactcacaaaccgaacccagaagtacattaaagggaccatacatcatgatcaagtgggttttctcccaggggtgcaagggttttccaatatctgaaaatcaatcagtgtgatataccacatcaaaaaattgaagaaaaaaatgatcatatcaatatgtgcagaaaaagcacttgacaaaatccaacacccatttctcataaaaaccctccagaaagtgggcatagagggaacctacctcagtatactaaaggccatatatcacaaactcagctaacatcattcacaatggtgaaaagctgaaagaagtcccactaagatcaggaatgagacaaggatgaccactctcctcactttattgaacatagttttggaagtcctagccatggcaaccagaggaaaaaaaagaaataaaaaggaatcaaaattgggaaaaaagaagtaaaaccgtcaccattgttgttgtttgcaggtgacataatactatatattcaaaattctaaagatattaccaaaaaactgttagaactcatcaatggattcgtaaagttgcaggttacaaaattaatacacagaaatctattgcatttctacatgctaacaatgaagatcagaaagagaaattaaggaaacaatcccatttactgtgacataaaaaagaataaaatacctaggaataacctaactaaagagacaaaacacgtgtattctgaaaactagatgatgttgatgaaagaaatcaaagatggtacaagcaaatggaaagatataccatgctcttggactggaagaattaatactgccaaaatgactatactatccaaggcaatctacagagtcaatgcaatcactatcaaattacaagggcatttttcacagaactagaacaaaaaaaatttaaatctgtatagaaacacaaaagacccccaacagccaaaggaatcttgagaaagaaaaattggcctggaagaatctggttacctaacttcagactataatacaaagctatcataatcaaaagagtatggcactggcacaaaaaacagaaatacagatcaatgggacagaatagaaaggccagaaataaacccacacagctatagtttactaatttaagacaaaggaggacagaatatacaatggagataaagtctctttaaaaaggtgagttgggaaaactggacagctacaggtagaagaatgaaattagaacatcctctaacaacatacacaaaaataaagtcaaagtagattaaagacctaaatataagaccagatactataaactcttagaggaaaacatagactgaacactctctgacataaactgctacaatatcttcttagaatcaactcctagggtaatgaatataaaaacaaaaataaacaaatgggacataaataaaagtttttgcacagtgaagtaaactatcaacaaaatgaaaagacaatgcacagaatgggagaaaatatttgcaaatgatgtaactgaaaagggataaatctccaaagcatacaaaccacccatgcagctcaatatcaaagaaaaaaaatcaaaataggcagaagttctaaacagacatttccccaaggaaaacatacagatgggcaaaaaaatgctcaatgttgataattattagagaaatagaaatcaaaactacttcgaggtattaccttataccagtcagaatggccattatttaaaaaatcaactagcaataaatgcttgagatggtgtggaggaaggggaaccctcttacaatgttggtgggaaaataaattgctataaccatatggaaaacattatggaggtccctcaaaaatctaaaagtaaaactaacatacaatctggcaaccccacagttaggcatcttctggagaaaaccataattcaaaaagatacatgcatcccaatgttaattacagcactttacaatagacaagacattgaagcagcctaatgcctgttgacagaggaatgaatagagaagatgtggtacatatatgcaatggaatattactcagccataaaaagaataaaataatgtcatttgcagcaacatggatggacctaagtgattgtcatattaagtgaagttacacagttaaagatcatatatcacttagatttggaatctaaaaaaaaaaaaaaaaaaggatacaaatgaacttatttgcagaagaaaaacagactcacaaacattgaaaacaagcttatggttaagaaagggaggagggatggaccaggggtttgggattggcaaatgcacactatgtaatgattggttaatggggatattccaggaatgaaggatggctcaatataggccaattagaacaaggaactctacttaatgttctgtgatggtctatgtgggaaaagaatctgaaaagaatggatgtctgcatgtatataaatttgttgtatagaagaaattatcacatcattgtaaatcaaccatacttcaataaaatattaaaaaaatcaaaaacctatccttaagaaattaggtaaattaatttggtgatgataaagatatgaatgaaggaaaacacagctaagttctaggattgatactttggggagaatcaataaaacaggaaaatatgtatatgaactgtgcatacaattagaaatatgaaaaatataaacaaacatgtttttatattctttttatttctgtatttttctttctctttttctttctttatatatttctaattatctataaatgaaaaagaatataaacatgagaaatatttgaaaaaataaaaaatattgattcaaaatattccccaaagagtataaaatatgaatagtcttatatatctataggattaactacagctaaaagaaatgatgaatggtgcatgggtgttattcaaaagtcacataaaggtgaacagactttttaaatacaggtaagattttaaaatttcaaatgattacattaagaaggtgccaaagacatctttttcccccaataattctatctcatatttcaaaacagggaatcctaggacatacaactgtactaaggcaagaaacactgaaggtatttatgagtacctacactatacttatttgaaaaatagcccaacaaacccacaccacctatatcttatgatacgattttgtttaatctaaatagaacgatgcgacatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagaataatcaaaggaaaatccaataaaactggtaagaatttgttttagtcatacacacacaacaaaagcattagcttttttccacagcagcagcagcagccagtcagaaaacacatgaagctcataacatcaaaatattctccaaaatgaaatacttagaaagaagagaatcacctttaaagaaaatgaaagagttgtgtgatgggtacctgaaaaatctgagagacataaaatacaatctggaaagaaacattcaatattgtaagattctttattttttcttcagaagagtgtattaatataacaatcaaaatcctaaaagggtcttcctttttgatattgaaacataaatcttaaggttcatttgacagactaaacaggtgagaatgtcgaaaaaataagtgagaatgtcaaggaaatactgaaacataatatattgttacctattaaaaatgaataaacaacactctatgatactacatcagaagagactagattaacaagacataatgggatgtatagaaacagactccaaaacatttaagtatttggtaaaagaataggaagccatgtcaaatcactgggggaaagggtatattatttaggatacaatgttggcatcatttattacctggaataaaatgaaatcatgtttctattttatactgcaaagaacaatggtttataagtggagcaaaaaattatgtggaaaaattagaatcactgaagaatagaaaaaagtacttgatgactaaaaatacttgacaaaaaagcacaaacaaggtaatgaaatttttttccctcactaataattatagaaatagaaaacacacatatacacaatcataatcatagaaagacaaaatgtagtttaaaggttcaggatacctttgttttgcccctccagttcactctccactggttttttccttactctctcctgcggggagacaacctgtttggaactacaagagggaccctatgtcctctggctttcaagggagtacagacaatagggagagtaagggaggatatatattcccctggttccctgcttgaaaagtcaccttggcctggctatgtttgttggccaaaggtcactgttcctctcaagatggctttctttacttgcttctctttcttcatgttctgaaaacctcttcctccctcatcccttttggcttttgggtggtaacagggctgttgctaatgtccaaaatttactgtattatctcttatattttcatcaacataccaccatcatctttgtaactattttatcctaatttgagtgtaccatctttacctgttggttgaattatgacagtaagtgtgtagggaagaactctaaaatacacatgttttagatatataaatccacataaactttctggaaaaaaattggtaatatattaaaaatattcaaatatgcttgccttttaataaagaattgattcttagaaatttgttccatggacataatcacagactatacaaggcagtatgggaaaatacttatcaaatatattgtcctcttaaattttgaaaaacttgaaataatgtcaacccatgataaaaaggataggataaatgtataataatgaatatatataaagaaataccatttacccattaaaatcatattttagaaaaaatacttcttaatagagaaaatattcaggatatattaccaaagcgaaaaagaccctataaaacaataaattcactatgataccaatttggtggtgcatatcatagtgcatatgtgagtggctatatggataaacacatgcatgtatgtacaaatatattttcatatacataagaatgatgcatagaaattatgaagtggtagtctgtgagtcagagaaattaacttgaaattcaaaattttagctgtgaagaaagagggctgttaaaattaatgaaggatactcatttgtctctaatcatttattataatatactacaaaccattccagacacttcttataagaatatagatacagaagttctaatgttcaaaatgtaatcagctatattttaaacttctttcacataaatcaagagattttgattttaatgagatcataaagattatgtatttgctacaaccaggctaaagccagagatcactaagatgtacttcaggtttataatacacaatattatagaccatgaactgataaatctaaatggatcctttcttttaccaattaacattaaccagtcttaaataggttagtacccatttaaaaatactttcttactgaaaataaaagaatttccaggataaattaatttttcaattcatttaagatctgaaaagagttctagattctaaaacataaactgggcatgaaaaaaatgtagcatttaaataagaaaatctattgaattatttttatttgtttggctatgtccatggcatgcagaagttcctgggcagggactgtaccacaccatagcagcaacctgagccacagtgacaccaccagatccttaacccactataccacaagggaacttcctaataaattattttatttacaaaaagtctgttaaatataacagcaattgcaactaaaattatcaggtataattcaatagataaattactgcaaaaatttaaatatattctattttaatgttgttacattaaaagacatcttcgtatctttttttggcttaatataacttaatttgcaataaaaagtaattgaaaaaaaggaaaaaaaattgataaaggagttccagacaatattttctgtggtgaagtaaatctttaaaataatatcataactataaaacgcatagatgtgttttaacaattatatactctattaaaaattcaaaaattttctttggaatttctggccacattgtcagacattcgaatgtgttcgcaagcatttttttataggaaaaaattaaaacagatattttgttgtaaaatcacacaataaatttactgattaaaacccacaaggctactctaattgaaatgataatagtgctgtaaatggtaagaatactatatataaacaagaattaaccaatgaacgacaaatagattaaaaagccacaaggtgatatgaatctctcaggaaagataacttaaaattatttgctattatacattactgtaaattattatctcctttccatctaatcatatataaataatttcttaaataataaatttctttaacaaaatttattatttaactttggctgataaattttcagtaaggtttcattggtcttcgagactaatcaattttttttctctctcaaaatcaaaaattcatacttattcaatgaattcttacaatattttcacccaatggtgaagaaggactttaaaaataactctggcttaaagtaaatatttagcagtttctaataggactgataccctctacataaatagaaattagggcagagcctagatttagagctggccccaaaagctaaaacaataaaaagacaaaggtcaggagtcaacaaccatcatggttatcttcacttcctactgaatatcagaacaacatgttgaaagacatttgattaaatgcttaaaaaatcagaataaatcattctttcaaaacatgataaaactcatctcttaagccaaaacttataagtaagacataagaaacacttccattaaaactaggtgtatccatatgaattttaaaaaattctgttctagtcctgtgaagaatgtagtttgataggattgcattgaatctatagattgccttgggtagtatagtcattttgacaattttgattctcctaatccaagatcgtggaatatttttccatctgtttgtgtaatctttgatttcttacatcaacatctttagttttcagagtataggtcttttgtctctttaagtaggtttattcctaagtattttattctttttgatgctactgtaaatggggtggtttctctgatttctctttctgatctttcattattaatatatagaaacgcaattgatttctgtgtattaactgtagcctacaactttgccacattcattgatgagttctaacagttttctggagctgtttagggttttctagttatagtatcatgtcatcaacaaggagggacaaactgaaaggttacatgtgaaagaatgaaagtagaacattatctaacaccatatacaaaaataaactcaaaatagagtaaagacctaaatataaagccagatactatcaaactcctagaggaaaacagacagaatgctctgaca

SEQ ID NO: 129 - DNA, 7807 bp, Artificial
  ss1126 sequence
  misc_feature (2755)..(2755): n is a, c, g, or t
tgtctgcttggggatgggggaggtccgggatgcttacacgggaaaatctagacctcatagtgtataaaagttactaagaacaaagacctggtgctcagactctggaggtgactcctctgagcccacacaggtgctgaataaaccttgcttttccatatctctgagtgctgtttgtctccttccattgccatggtttttgcggtttccgcaacatttttggtgcattagccgggaagccgacaaccgagctggcttcttgtgccaccgttgtcagggaaccgggggaggccatggtcgctggcccagtgacaggtggatagtgcgcactggccattttgctggatccagaccctcactccagccatgatggccttggctcacactgcttcccgaacagactcagaaggagagtggagacaggttccaggacaggacgttgaactggcaagtgccccggggacatctgcccgagtcagcacctgtcatacagtggaaggagagactgatcacctctcagtgaccaaagggtcactcaggtcagggtttgctctcttgggatcgggaggcttgtcaattctggtgtgtgtgtgtgagtgactagagaaaatgagagcccgtgctccaccatctttggactacggagccagagtgagtcctaacctgcagttctgtggcaacctcatacagcttctggtggccctctttggggggatcctgactttggggtttatacagtcccacctatgctaagaggtgcctgaaatatctcccccaggagagcggtcaggtggacgaagtgattgttacctgaggccttgtcctcactctttgtcttgcatcaccagcacacggtgggacttcacacaatgggtaaatcggcttccaagcccactgtcttagagtgtgtggttaagaattttaagaaagggttttctagagagtatggtgttaaactgagtcctagaaaactttgtaccctctgtaccctagagtggccctcctttggtgttggctggcctctggaagggatcttagatatgttcccagttgcagcagtatataatgttataacaggggaccctggacacccagaccaatttctctatattgatcaatggttggaaattgcctatttgaggcccccatgggtttggttcttccctacagaccagggacagtgtagggtgctagtagcccagtccaagaagaaaaccttgtctcaaaaaaaggtgccacatatttttcaaggggaacctgatgactcgccccctatgccaccgccttatgtgctgccggccccacctctgggagccgaatgtccccagatgccagatagcccactgccttctgtttctcctcctccttctgcttctgaagttcccaaggcaatgtcacccccacaaccagattctccagaacctatgagcaggcgcctctggtcagctcagggagcagccactccagcattgcaaatgcccttacgggagacacggggaccatggcaatttgtccccgatgggaccatacaagaggggagatgagttttttattaccagcccctttccactgccgatctcctcaactggaaacaccatactccctcatattctgaaaagcctcaggtgctaattgatctcttagaattcattttccagacacactgtcccacctggatagactgccggcaactcctttttactctgtttgacactgaagagcgctggcgaattgtaacagaagccccaaaatggcttcaggccaatgcagggcatcgagcagacttggcaaactgggtgagggaagccttcccagaagaaaacccccagcgggactatgacattgaagaagggaaacgtaacctagagaggtactggcaggccttcctacagggggcaaaagctggggctaaaaggcccactaatagagctaagatcagtgagataccacaagagctgaatgaaagcccagccaaactctatgagagactatgtgaggctttccgaatctacaccccttttgatcccgaggcccctgagaaccaacggatgataaatgctgcctttgtgggacaagcccaatcagatatccgtaaaaggctacagaaattagaaggatttgcaggagaggaggccactaaactgttggaaatagccaacaaagtttttattaaccgagaccaggtggcccgccgtgatgcaagaacgagaatgaaacaaaaagtgactcttctggcggctgccctgtcaaaaccggtgcccccagtgggaccaccccataggggacaaggcacaaggccagggacaaggcacaaggccaggggacaaggcacaaggcccctggaacatgaccaatgcgcttactgcaaagaaaagagacattggaaaaatgaatgccccaaccatcctgagaaaatgaccaaggccccacctagctggtaccgatctgaaccattcagcaccaacctgattggcctagctgagtctgattaggggggaccaggctctctccaactgggcccccgagagcctatggtcagaattcaagtagggggccaccccatagactttatggttgacacaggtgctgaactttctgtggttacacaagctgtagctcccctcttggggaaagaaaccaccatcgttggggccacaggtaaccaaacccacaggcccttctgtggtcctcaacgatgttggttaggaggccatgaaataatacatgaatttctttacctgcctgactgcccagtccncctgatgggaagagacctgctggctaaaatggaggcacaaatttccttttctactgatggatcagcccaactcaaattgacagaacccccctctcctttaatcatggctcttgctgtaaaaagggaagaggaatggtgcttgtactcttccccttcagagatggggacatttccccagaactagagactaaatacccattggtttgggctgaaggaaatccaccaggactggcaaaatgccatgctcctgtcttgattgatctaaaacctgaagctcagggggtaaagctacgacaatactcaatttccagagaagctcgactgggaatccaggttcacctggataggctgcttcagcacggactgttaataaatgtcagtccccttggaacacccctttactgctcgtaaaaaaaccgggaacacaagactactgcccagttcaggacctgagagccataaatgaagcaaaagtcacattacacctggccgtccctaaccctagccgctgacatggctgaatttcctggacaaaagttgagctgtgttttactacaatgtgttgacaacctcttactggatggcaccacggaggctcagtgcctagaggaaacaagagctctcctttccctactgacggaggcatggtatcaggtatcaaagaaaaagtcacaaatctgtaaaaaaacaagtcaagtatctgggctttaacatcatgcagggccaacgaatgctgggcactgaaagaaaggcagtttgtgccattcctgtccctaccacctgccagaaggttcgtgagttcctaggggcagcaggattctgctggatatggatctctgggttttcagacttggccaggcctctgtatgaggctctaaaaggggaagaaaaggctccccttgaatggggaccaagccaggagacagcatttcagacaatcaaaaccaaactcactgaggctccagccttgggacttcctgatgttacctgaggatttaacctttttgttcatgagaaaaatggaatggctttgggagtcttaactcaagaatttgggcctttgcagaggccagtggcatatctgtctaaacaaattgactcagttgcagctggatggcctccctgtctccaagcgctggcagctaccaccttgttggtgagagaggctgacaagttgactctgggacaaaacctcaatgttaaagtcccacactcagttgtaaagcctaatggataccaggggccaccattggctcacacatgcacgaatgactcaatttatcaagggttactatgtgaaaatccatgggtaaaattggaggttgtacgaactctgaacccagctacttttctgccagatgaagtggggtccccagaccataactgcctggaggtactagatgaggtgctttccagcaggcctgacttgactgataaaccactccaaaatcctgacctggtttatatactgatggcagcagctttttggaggatagaaaaaggatggcaggatatgctgtggtatctgacttaaaagtaatagaagcagaggtgcttcctcaagactagtcagcacagagagcagaattatgggccttaatcagagcactggaactcagccaagaccagtgagttaatatctataccgactcacgatatgcctttgcaactttgcatgtttatggagccttatataaagaaagaagactcctcactgctgaaggaaaagggattaaaaaccaggctgaaatgttaaagctcctagaggcagtatgggaacctaaagaagctgcagttatccactgtaaaggccaccaaaagggggatgacccagtgacaaaaggaaaccgtagtgctgatgcagctgccagacaggcagcccggggacaacagccagacaaacctaaggtcttgctggccccagaagtgccagctgtctccagatattctccagaggggaaaaaaacgaataaggaaaaaaggaggaactaaaactaagacggggtggtgggtcacatgggaccactgaatttatgttccagaacagctggcctacaaactagtccaccaacaacatgagctaagccacatgggcaaaactgccttagagaccctactgggctggtactatctcattgctcatcttcctgcactctgctcctctgtctcccaaagatgcataacctgtttgcagaataatgcccaccaggcaccccacagaccagctggggcacaacactgtggtctgtccccatttgaggatatggaagtggacttcactgaggtcacccctagtaaggggtacaaatatttactagtttttatctgtactttttcagattgggtagaggccttccctacccgaactgaaaaggcaagggaagtaaccaaggcactcctgagagacattattcccagatatggaatgcctctgaccatcaggtcagataatggactggcatttgtggccgaaacagtacaacaggtggcaaaagctttacagatccgatggaaactacattctggttatcgccctcaaagttcagggaaagtaaaacgcatgaacggaacacttaaacagaccctggcaaagttatgtcaggaaacttgcttgccctgggtagacatgttgctggtggccctcctaaaagtgagatgctcaccccgagcgggaataggattctcaccatttgaaatcttatatgggaggccacctccactaatcagtttaaaaggaaacaccagggagttgggagacttggaattacataaacaattataaggactggggctcactatttctcagatacataaatgggtcacagacagaatacttgtgtccttaggtataacagtacacccccacaaggtgggggaccaggtgtggataaaggactggaaaaaggagtctttgaggctggtatggaagggcccctatactgtaattctagccacgcccactgctcttaaagaaacaggactatatgcttggatccatcattccagagttaaactggctggcccagctgatgactgtggagagtgggagactgccctcgatctggagagacctctttgcctgacaatacagaggaggagacaccgacctcaaagccctgccctgaccacaccggaagctggtcagtcaacgcacggctgaagcttgaggaatcagctgcctgtgaacccaaatggaaggagggtttcaaaataagcatttgcattgacggaagaggcctagaccctggagctgtgctacatttccagagaatcatgtttgcgctccaagctgcctctcacagggtctttcattccttttatgaagagataaaaaataccccacctcccattccggccacaactaagaacttgttcttagccctggcagaaactattgcacaaactctcaaggtctcctcttgttacgtatgcgggggaatgaacacaggagaccactggccttggcaagccagagaacgggacccattagagcctcataatgagactgcaaacccccaactcaccaatggggtatggctcctcagaactgctatcatagggagaaattgttttgcgaggcggggaggacggtttaatgtttcagttggaagcctaacatgtttaggcctgaggtattataatctgactgcccaagagactcaatggtggtcatctgccaacctctcagagcccaagcctaatcccctgtccaatttttcccacctctgacaggcatgggaagacacctctgacagtgctaatatccaatggcgggcaccaaagggattatattagatttgtgaaaaaatgtcctattccatactcccccccaattgggctggggcatatgtactgggaacaatcagaccttccttcttcctgctcccgctgtcactaggggagcaactgggagttcctatatacagggcacagggtgcccagagagaccggagggctctccaaattggagactggaaagatgatgaatggcccccagaacagataattcaatattatgggcctgccacctgggcagaggatggctcttggggatatcgcacccctatctatatgctgaaccgcatcatcagactacaggcggttttggaacttataacaaatgacactgcaagggccttgactatattggcccaacaacaaactaaaatgcacagtgcaatctaccaatatcacttggccttggattatttacttgcttctgaaggaggggtttgtggaaaatttaacttaagtaattgctgtctacaaatagatgacaccagaaaggtggtagaagaaattgctgactgcatgactaaacttgcccatgtacctgtacaagcttggaaaggatgggatgcagaccgtctctttggtaaatggttctcttggttgggaggaattaagacaatggttggaataatcatggttatacttgcagggtgcctatttgttccctgccttgtacctctcctgataaatattataaaaggttttataaaaaccatggttgaaagaaaaacagcctcccacctgctacttatcagaggttaccaaagggatatgactgatgatgatctgtaaagggtgcagatgcaccctgaatgtcaagaggggggagtgaaatggagttttaactaaagaacaaccctcccccccttggctaagaaggcagctgcaagcctttccagctgtgctcatcactatgccacctttcttgtaataatgtaacaactgtgtgctctctgtccaagccagcagccctgctaatcaggcacccagcattgcttatcagttccacctctgtaaccttgcttgctcagtttcttagggaggaacactgtctgcttggggatggggggaggtctgggatgcttacatgggaaaatctagacctcatagtgtataaaagttactaagaacaaagacctggtgctcagactctggaggtgactcctctgagcccacacaggtgctgaataaaccttgcttttccatatctctgagtgctgtttgtctccttccattgccacggtttttgcagtttccgca

SEQ ID NO: 130 - DNA, 7783 bp, Artificial
  ss1127 sequence
tgtctgattggggatgggggaggtccgggatgcttacatgggaaaatctagacctcgtagtgtataaaatttactaagaacaaagacctggtgctcagactctggaggtgactcctctgagcccgcacaggtgctgaataaaccttgcttttccatatctctgagtgctgtttgtctccttccattgccatggtttttgcagtttccacaacatttttggtgcattagccgggaagccgacaaccgagctggcttcttgtgccaccattgtcagggaactgggggaggccatggtcgctggcccggtgacaggtggatagtgcacactggccattttgctggatccagaccctcactccagccatgatggccttggctcacactgcttcccgaacagactcagaaggagagtggagacaggttccaggacaggacgttgaactggcaagtgccccagggacatctgcctgagtcagcacctgtcatacagtggaaggagagactgatcacctctcagtgaccaaagggtcactcaggtcagggtttgctgtcttgggatcgggaggcttgtcaattctggtgtgtgtgtgtgtgagtgactggagagaacaagagcccatgctccaccgtccttggactacagagccagagtgagtcctaacctgcggttccgtggtgaccctcatatggcttctggtggccctctttggggggatcctgacgttggggtttatacagtcccacctatgcgaagaggtgcctgaaatatctcagccgggggagcggtcaggtggacgaagcaattgttacctgaggccttgtcctcactctttgtcttgcatcaccagcacacggtgggacttcacacaatgggtaaatcggcttccaagcccactgtcttagagtatatggttaagaattttaagaaagggttttctagagattatggtattaaactgagtcctagaaaactgtgtaccctctgtaccctagagtggccctcctatggtgttggctggcctccggaagggatcttagatatgttcccagttgcagcagtatataatgttatagcaggggaccctggacacccagaccaatttctgtatattgatcaatggttggaaattgcctatttgaggcccccatgggttcggttcttccctacagaccagggacagtgtagggtgctagtagcccagtccaagaagaaaaccttgtctcaaaaaaaggtgccacatatttttcaaggggaacctgatgactcgccccctatgccaccaccttatgtgctgccggccccacctctgggagccgaatgtccccagatgccagatagcccactgtcttctgtttctcctcctccttctgcttctgaagttcccaaggcaatgtcacccccacaaccagattctccagaacctatgagcaggcgcctctggtcagctcagggagcagccactccagcattgcaaatgcccttacgggagacacggggaccatggcaatttgtccccgatgggaccatacaagaggggagatgagttttttattaccagcccctttccactgccgatctcctcaactggaaacaccatactccctcatattctgaaaagcctcaggtgctaattgatctcttagaattcattttccagacacactgtcccacctggatagactgccggcaactcctttttactctgtttgacactgaagagcgctggcgaattgtaacagaagccccaaaatggctttaggccaatacggagcattgagcagatttggcaaactggatgagggaagccttcccataagaaaacccccaccgggactatgacattgaagaagggaaacgtaacctagagaggtactggcaggccttcctacagggggcaaaagctggggctaaaaggcccactaatatagctaagatcagtgagatactacaagagccaaataaaagcccaggcaaactctatgagagactatgtgagcctttccgaatctacaccccttttgatcccaaggcccctgagaaccaacagatgataaatgctgcctttgtgggacaagcccaatcagatatatttaaaaagctacagaaattagaaggatttgcaggagagaatgctgctaaactgttggaaattaacaaggtttttattaaccgagaccaggtggcccgccgtgatgcagaaaagagaataaaacaaaaagttactcttatggcagccaccctgtcaaaaccggtgcccccagtgggaccaccccgtaggggacaaggcccaaggccagggaaaaggagtcccctggaacatgaccaatgcacttactgcaaagaaaaggggcattggaaaaatgaatgccccaaccatcctgagaaaatgaccaaggccccacctagctggtaccgatctgaaccattcagccccaatctgattggcctagctgagtctgattaggggggaccaggctctctccaactgggcccccgagagcctatggtcagaattcaagtagggggccaccccatagactttatggttgacacaggtgctgaactttctgtggttacacaagctgtagctcccctcttggggaaagaaaccaccatcgttggggccacaggtaaccaaacccacaggcccttctgtggtcctcaacgatgttggttaggaggccatgaaataatacatgaatttctttacctgcctgactgcccagtccccctgatgggaagagacctgctggctaaaatggaggcacaaatttccttttctactgatggatcagcccaactcaaattgacagaacccccctctcctttaatcatggctcttgctgtaaaaagggaagaggaatggtgcttgtactcttccccttcagagatggggacatttccccagaactagagactaaatacccattggtttgggctgaaggaaatccaccaggactggcaaaatgccatgctcctgtcttgattgatctaaaacctgaagctcagggggtaaagctacgacaatactcaatttccagagaagctcgactgggaatccaggttcacctggataggctgcttcagcacggactgttaataaatgtcagtccccttggaacacccctttactgctcgtaaaaaaaccgggaacacaagactactgcccagttcaggacctgagagccataaatgaagcaaaagtcacattacacctggccgtccctaaccctagccgctgacatggctgaatttcctggacaaaagttgagctgtgttttactacaatgtgttgacaacctcttactggatggcaccacggaggctcagtgcctagaggaaacaagagctctcctttccctactgacggaggcatggtatcaggtatcaaagaaaaagtcacaaatctgtaaaaaaacaagtcaagtatctgggctttaacatcatgcagggccaacgaatgctgggcactgaaagaaaggcagtttgtgccattcctgtccctaccacctgccagaaggtttgtgagttcctaggggcagcaggattctgctggatatggatctctgggttttcagacttggccaggcctctgtatgaggctctaaaaggggaagaaaaggctccccttgaatggggaccaagccaggagacagcatttcagacaatcaaaaccaaactcactgaggctccagccttgggacttcctgatgttacctgaggatttaacctttttgttcatgagaaaaatggaatggctttgggagtcttaactctagaatttgggcctttgcagaggccagtggcatatctgtctaaacaaattgactcagttgcagctggatggcctccctgtctccaagcgctggcagctaccaccttgttggtgagagaggctgacaagttgactctgggacaaaacctcaatgttaaagtcccacactcagttgtaaagcctaatggataccaggggccaccattggctcacacatgcacgaatgactcaatttatcaagggttactatgtgaaaatccatgggtaaaactggaggtggtacgaactctgaacccagctacttttctgccagatgaagtggggtccccagaccataactgcctggaggtactagatgaggtgttttccagcaggcctgacttgactgataaaccactccaaaatcctgacctggtttatatactgatggcagcagctttttggaggatagaaaaaggatggcaggatatgctgtggtatctgacttaaaagtaatagaagcagaggtgcttcctcaagactagtcagcacagagagcagaattatgggccttaatcagagcactggaactcagccaagaccagtgagttaatatctataccgactcacgatatgcctttgcaactttgcatgtttatggagccttatataaagaaagaagactcctcactgctgaaggaaaagggattaaaaaccaggctgaaatcttaaagctcctagaggcagtatgggaacctaaagaagctgcagttatccactgtaaaggccaccaaaagggggatgacccagtgacaaaaggaaaccgtagtgctgatgcagctgccagacaggcagcccggggacaacagccagacaaacctaaggtcttgctggccccataagtgccagctgtctccagatattctccagaggaaaaaaaaaaaatgaataaggagaaaaggaggaactaaaactaagacggggtggtgggtcacatgggaccactgaatttatgttccagaacagctggcctacaaactagtccaccaacaacatgagctaacccacatgggcaaaactgccttagagaccctactgggctggtactatctcattgctcatcttcctgcactctgctcctctgtctcccaaagatgcataacctgtttgcagaataatgcccaccaggcaccccacagaccagctggggcacaacactgtggtctgtccccatttgaggatatggaagtggacttcactgaggtcacccctagtaaggggtacaaatatttactagtttttatctgtactttttcagattgggtagaggccttccctacccgaactgaaaaggcaagggaagtaaccaaggcactcctgagagacattattcccagatatggaatgcctctgaccatcaggtcagataatggaccggcatttgtggccgaaacagtaccacaggtggcaaaagctttacagatccgacggaaactacattctggttatcgccctcaaagttcagggaaagtaaaacgcatgaacggaacccttaaacagaccctggcaaagttatgtcaggaaactggcttgccctgggtagacatgttgctggtggccctcctaaaagtgagatgctcaccccgagcgggaataggattctcaccatttgaaatcttatatgggaggccacctccactaatcagtttaaaaggaaacaccagggagttgggagacttggaattacataaacaattataaggactggggctcactatttctcagatacataaatgggtcacagacagaatacttgtgtccttaggtataacagtacacccccacaaggtggggggaccaggtgtggataaaggattggaaaatggattctttgaggccggtatggaagggcccctatactgtaattctagccacgcccactgctcttaaagaaacaggactatatgcttggatccatcattccagagttaaactggctggcccagctgatgactgtggagagtgggagactgccctcgatctggagagacctctttgcctgacaatacagaggaggagacaccgacctcaaagccctgccctgaccacaccggaagctggtcagtcaacgcacggctgaagcttgaggaatcagctgcctgtgaacccaaatggaaggagggtttcaaaataagcatttgcattgacagaagaggcctagaccctggagctgtgctacatttccagagaatcatgtttgcactccaagctgcctctcacagggtctttcattccttttatgaagagataaaaaataccccacctcccattccagccacaactaagaacttgttcttagccctggcagaaactattgcacaaactctcaaggtctcctcttgttacatatgcaggggaatgaacacaggataccactggccttggcaagccagagaacgggacccattagagcctcataatgagactgcatacccctaactcaccaatggggtatggctcctcagaactgctaacatagggaaaaattgtcttgcgaggcagggaggatggtttaatgtttcagttggaagcctaacatgtttaggcctgaggtattataatctgactgccccaaatactcaatggtggttatcctccaacctctcagagcccaagcctaatcccctgtccaatttttcccacctctgacaggcatgggaagacacctctgacagtgctaatatccaatggcgggcaccaaagggattatattagatttgtgaaaaaatgtcctattccatactccccccccaattgggctggggcatatggtactgggaaaaattagaccttccttcttcctgctcccgctgtcactaggggagcaactgggagttcctatatacagggcacagggtgccctgagagaccagagggctctccaaattggagactggaaagatgatgaatggcccccagaaagaataattcaatattatgggcctgccacctgggcagaggatggctcttggggatatcgcacccctatctatatgctgaaccgcatcatcagactacaggcggttttggaacttataacaaatgacactgcaagggccttgactatattggcccaacaacaaactaaaatgcacagtgcaatctaccaatatcacttggccttggattatttacttgcttctgaaggaggggtttgtggaaaatttaacttaagtaattgctgtctacaaaaaatgacccggaaaggtggtagaagaaattgctgactgcatgactaaacttgcccatgtacctgtacaagcttggaaaggatgggatgcagacagtctctttggtaaatggttctcttggttgggaggaattaagacaatggttggaataatcatggttatacttgcagggtgcctatttgttccctgccttgtacctctcctgataaatattataaaaggttttataaaaaccatggttgaaagaaaaacatccttccacctgctacttatcagaggctaccaaagggttatgactgatgatgatctgtaaaggatgcagatgcaccctgaacatcatgagggggggtgaaatggagttttaaataaagaacaaccccccccttggctaagaaggcagctgcaagcctttccagctgtgctcatcactatgccacccttcttgtaataatgtaacaactgtgtgctctctgtccaagccagcagcccggctaatcaggcacccagcattgcttatcagttccacctctgtaaccttgcttgctcagtttcttagggaggaacactgtctgcttggggattgggggaggtctgggatgcttacatgggaaaatctagacctcatagtgtataaaagttactaagaacaaagacctggtgctcagactctggaggtgactcctctgagcccacacaggtgctgaataaaccttgcttttccatatctctgagtgctgtttgtctccttccattgccatggtttttgcagtttccgca

SEQ ID NO: 131 - DNA, 7802 bp, Artificial
  ss1129 sequence
tgtctgctggggatgggggggtccgggatgctacactggggaaaatctagacctcatagtgtataaaagttactaagaacaaagacctggtgctcagactctggaggtgactcctctgagcccacacaggtgctgaataaaccttgcttttccatatctctgagtgctgtttgtctccttccattgccatggtttttgcggtttccgcaacatttttggtgcattagccgggaagccgacaaccgagctggcttcttgtgccaccattgtcagggaactgggggaggccatggtcgctggcccggtgacaggtggatagtgcacactggccattttgctggatccaaaccctcactccagccatgatggccttggctcacactgcttcccgaacagactcagaaggagagtggagacaggttccaggacaggacgttgaactggcaagtgccccggggacatctgcctgagtcagcacctgtcatacagtggaaggagagactgatcacctctcagtgaccaaagggtcactcaggtcagggtttgctctcttgggatcgggaggcttgtcaattctggtgtgtgtgtgtgagtgactggagagaacgagagcccgtgctccaccatctttggactacggagccagagtgagtcctaacctgcagttccgtggcaacctcatacagcttctggtggccctcttcagggggatcctgacgttggggtttatacagtcccacctatgctaagaggtgcctgaaatatctcccccaggagagcggtcaggtggacgaagtgattgttacctgaggccttgtcctcactctttgtcttgcatcaccagcacacggtgggacttcacacaatgggtaaatcggcttccaagcccactgtcttagagtgtgtggttaagaattttaagaaagggttttctagagattatggtattaaactgagtcctaggaaactgtgtaccctctgtaccctagagtggccctcctttggtgttggctggcctccggaagggatcttagatatgttcccagttgcagcagtatataatgttatagcaggggaccctggacacccagaccaatttctgtatattgatcaatggttggaaattgcctatttgaggcccccatgggttcggttcttccctacagaccagggacagtgtagggtgctagtagcccagtccaagaagaaaaccttgtctcaaaaaaaggtgccacatatttttcaaggggaacctgatgactcgccccctatgccaccaccttatgtgctgccggccccacctctgggagccgaatgtccccagatgccagatagcccactgccttctgtttctcctcctccttctgcttctgaagttcccaaggcaatgtcacccccacaaccagattctccagaacctatgagcaggcgcctctggtcagctcagggagcagccactccagcattgcaaatgcccttacgggagacacggggaccatggcaatttgtccccgatgggaccatacaagaggggagatgagttttttattaccagcccctttccactgccgatctcctcaactggaaacaccatactccctcatattctgaaaagcctcaggtgctaattgatctcttagaattcattttccagacacactgtcccacctggatagactgctggcaactcctttttactctgtttgatactgaagagcgctggcgaattgtagcagaagccccaaaatgacttcaggccaatgcagggcctcgagcagacttggcaaactgggtgagggaagccttcccagaagaaaacccccagcgggactatgacattgaagaagggaaacgtaacctagagaggtactggcaggtcttcctacagggggcaaaagctgggactaaaaggcccactaatagagctaagatcagtgagatactacaagagctgaatgaaagcccagccaaactctatgagagactatgtgagtctttccgaatctacaccccttttgatcccgaggcccctgagaaccaacagatgataaatgctgcctttgtgggacaagcccaatcagatatccgtaaaaagctacagaaattagaaggatttgcaggagaggaggccactaaactgttggaaatagccaacaaagtttttattaaccgagaccaggtggcccgccgtgatgcaagaacgagaatgaaacaaaaagtgactcttctggcagccgccctgtcaaaaccggtgcccccagtgggaccaccccataggggacaaggcacaaggccagggacaaggcacaaggccaggggacaaggcacaaggcccctggaacatgaccaatgcgcttactgcaaagaaaaagacattggaaaaatgaatgccccaaccatcctgagaaaaagaccaaggccccacctagctggtaccaatctgaaccattcagcaccaacctgattggcctagctgagtctgattggggggaccaggctctctccaactgggcccccgagagcctgtggtcagaattcaagtagggggccaccccatagactttatggttgacacaggtgctgaactttctgtggttacacaagctgtagctcccctcttggggaaagaaaccaccatcgttggggccacaggtaaccaaacccacaggcccttctgtggtcctcagtgatgttggttaggaggccatgaagtaatacatgaatttctttacctgcctgactgcccagtccccctgatgggaagagacctgctggctaaaatggaggcacaaatttccttttctactgatggatcagcccaactcaaattgacagaacccccctctcctttaatcatggctcttgctgtaaaaagggaagaggaatggcgcttgtactcttccccttcagagatggggacatttccccagaactagagactaaatacccattggtttgggctgaaggaaatccaccaggactggcaaaatgccatgctcctgtcttgattgatctaaaacctgaagctcagggggtaaagctacgacaatactcaatttccagagaagctcgactgggaatccaggttcacctggataggctgcttcagcacggactgttaataaatgtcagtccccttggaatacccctttactgctggtaaaaataccaggaacacaagactaccacccagttcaggacctgagagccataaatgaagcaacattcacattacacctggctgtccctaaccctagccgctgacatggctgaatttcctggacaaaaattgggctgtgttttactacagtgcattgacaacctcttactggctggcaccacagaggctcagtgcctagaggaaacaagagctctcctttccctactgacggaggcagggtatcaggtatcaaagaaaaaggcacaaatctgtaaaaaaaacaagtcaagtatctgggctttaacatcatgcagggccaacgaatgctggggactgaaagaaagcaggcagtttgtgccattcctgtccctaccacccgctggaaggttcgtgagttcctaggggcagcaggattctgctggatatggatccccgggttttcagacttggccaggcctctgtatgaggctctaaaaggggaagaaaaggctccccttgaatggggaccaagccaggagacagcatttcagacaatcaaaaccaaactcactgaggctccagccttgggacttcctgatgtaaccagaggatttaaccttttaagccttaaatggaatggctttgggagtcttaactcaagaatttgggcctttgcagaggccagtggcatatctgtctaaacaaattgactcagttgcagctggatggcctccctgtctccgagcgctggcagctaccaccttgttggtgagagaggctgacaagttgactctgggacaaaacctcaatgttaaagtcccacactcagttgtaaagcctaatggataccaggggccaccattggctcacacatgcacgaatgactcaatttatcaagggttactatgtgaaaatccatgggtaaaactggaggtggtacgaactctgaacccagctacttttctgccagatgaagtggggtccccagaccataactgcctggaggtactagatgaggtgttttccagcaggcctgacttgactgataaaccactctaaaatcctgacctggtttatatactgatggcagcagctttttggaggatagaaaaaggatggcaggatatgctgtggtatctgacttaaaagtaatagaagcagaggtgcttcctcaagactagtcagcacagagagcagaattatgggccttaatcagagcactggaactcagccaagaccagtgagttaatatctataccgactcacgatatgcctttgcaactttgcatgtttatggagccttatataaagaaagaagactcctcactgctgaaggaaaagggattaaaaaccaggctgaaatcttaaagctcctagaggcagtatgggaacctaaagaagctgcagttatccactgtaaaggccaccaaaagggggatgacccagtgacaaaaggaaaccgtagtgctgatgcagctgccagacaggcagcccggggacaacagccagacaaacctaaggtcttgctggccccagacgtgccagctgtctccagatattctccagaggggaaaaaaacgaataaggaaaaaaggaggaactaaaactaagacggggtggtgggtcacatgggaccactgaatttatgttccagaacagctggcctacaaactagtccaccaacaacatgagctaacccacatgggcaaaactgccttagagaccctactgggctggtactatctcattgctcatcttcctgcactctgctcctctgtctcccaaagatgcataacctgtttgcagaataatgccctccaggcaccccacagaccagctggggcacaacactgtggtctgtccccatttgaggatatggaagtggacttcactgaggtcacccctagtaaggggtacaaatatttactagtttttatctgtactttttcagattgggaagaggccttccctacctgaactgaaaaggcaagggaagtaaccaaggcactcctgagagacattattcccagatatggaatgcctctgaccatcaggtcagataatggaccggcatttgtggccgaaacagtacaagaggtggcaaaagctttacagatccgatggaaactacattctggttatcgccctcaaagttcagggaaagtaaaacgcatgaacggaacccttaaacagaccctggcaaagttatgtcaggaaactggcttgccctgggtagacatgttgctggtggccctcctaaaagtgagatgctcaccttgagcgggaataggattctcaccatttgaaatcttatatgggaggccacctccactaatcagtttaaaaggaaacaccagggagttgggagacttggaattacataaacaattataaggactggggctcactatttctcagatacataaatgggtcacagacagaatacttgtgtccttaggtataacagtacacccccacaaggtgggggaccaggtgtggataaaggattggaaaaaggagtctttgaggcctgtatggaagggcccctatactgtaattctagccacgcccactgctcttaaagaaacaggactatatgcttggatccatcattccagagttaaactggctggcccagctgatgactgtggagagtgggagactgccctcgatctggagagacctctttgcctgacaatacagaggaggagacaccgacctcaaagccctgccctgaccacaccggaagctggtcagtcaacgcacggctgaagcttgaggaatcagctgcctgtgaacccaaatggaaggagggtttcaaaataagcatttgcattgacggaagaggcctagaccctggagctgtgctacatttccagagaatcatgtttgcactccaagctgcctctcacagggtctttcattccttttatgaagagataaaaaataccccacctcccattccagccacaactaagaacttgttcttagccctggcagaaactattgcacaaactctcaaggtctcctcttgttacatatgcaggggaatgaacacaggataccactggccttggcaagccagagaacgggacccattagagcctcataatgagactgcatacccctaactcaccaatggggtatggctcctcagaactgctaacatagggaaaaattgtcttgcgaggcagggaggatggtttaatgtttcagttggaagcctaacatgtttaggcctgaggtattataatctgactgcccatatactcaatggtggttatcctccaacctctcagagcccaagcctaatcccctgtccaatttttcccacctctgacaggcatgggaagacacctctgacagtgctaatatccaatggcgggcaccaaagggattatattagatttgtgaaaaaatgtcctattccatactcccccccaattgggctggggcatatgtactgggaacaatcagaccttccttcttcctgctcccgctgtcactaggggagcaactgggagttcctatatacagggcacagggtgcccagagagaccggagggctctccaaattggaaactggaaaggtgatgaatggcccccagaacggataattcaatattatgggcctgccacctgggcagaggatggctcttggggatatcgcacccctgtctatatgctgaacagcatcatcagactacaggcggttttggaacttataacaaatgacactgcaagggccttgactatattggcccaacaacaaactaaaatgcacagtgcaatctaccaatatcacttggccttggattatttacttgcttctgaaggaggggtttgtggaaaatttaacttaagtaattgctgtctacaaatagatgacaccagaaaggtggtagaagaaattgctgaccgcatgactaaactagcccatgtacctgtacaaacttggaaaggatgggatacagacagtctctttggtaaatggttctcttggttgggaggaattaagacaatggtcggaatagtcatggttatactcgcagggtgcctacttgttccctgccttgtacctctcctgataaatattataaaaggttttataaaaaccatggttgaaagaaaaacagcctcccacctgctacttatcagaggctaccaaagggttatgactcatgatgatctctaaagggtgcagacgcaccctgaatgtcaagaggggggagtgaaatggagttttaactaaagaacaaccctcccccccttggctaagaaggcagctgcaagcctttccagctgtgctcatcactatgccacccttcttgtaataatataacaactgtgtgctctctgtccaagccagcagccctgctaatcaggcacccagcattgcttatcagttccgcctctgtaaccttgcttgctcagtttcttagggagaaacactgtctgcttggggatggggggaggtctgggatgcttacacgggaaaatctagacctcgtagtgtataaaagttactaagaacaaagacctggtgctcagactctggaggtgactcctctgagcccacacaggtgctgaataaaccttgcttttccatatctctgagtgctgtttgtctccttccattgccacggtttttgcagtttccgca

SEQ ID NO: 132 - DNA, 3913 bp, Artificial
  ss1128 sequence
cttgtgggccgtaaagaaaaatctatgccttctgctccccctcagactgatccctttcttgatgagagtttaaataagcctttagctgtggaggcaacactaactccccttcaatcagccctaaaatctgctagtctagaggctcgaacctaaaactactgcccctgatcctcaagtcccaggataaaatatccatgcgcataacccttttgattttaaagctcttaaagctcttcgggagagtgtaatacagaatggagttacagctctctttactatgagcatggtagaaagcatggggacacttcagcttcccccgtgggcttggcatatgatagccaaagccaccctagatggtacagactatttaatttggaagtctagcctttcagatttttgtcaggaacaggcttgcttaaaacgaaaagacaatgctccaattcaacatacttttgaaatgttggttgggacaggcccttttcttgactcagcaaaacaactgacttaagatcctgagcctggctgcctgaagagcctggatgacaattcctgagagaggaaatccacaaggatcttttgtacaatgccttcaaggccctacagaaccttacccacagtttgtggactgccctaactcgagcagtatgttgccaagtagcacattctcaggccacagatattttaattggcatatgaaaatgcaaatgaagactgtaaaagggcaatggcctcctaagaaattcaggaggcacctttgattttattaagatgtgtcaagatgtaggaagtacaggttatgctcaagcaatgcttgctgcagcactgaaaggaacttagcagctcaggaaagagatgttttaattgtggaaaagaaggacattttcggaaagaatgtagagctcaattaacagggaaatcatccctagcaacaggatcatctccaggacctgagcataaccctggtttatgttctccatgtcagaaaggaaatcactgggcgaatcaatgttggtctcagtttcaccaaaacggcactctattaacaaccattagcaacttcggtgtctggaaatgggaacaggaatcgggaatcagggcctagccccagccccatcaaccaatgagggcatttgtggctcaaacagatcttaagataggaaagagttgccagaaagaaaggggagcatcaggatttggacgttcagggacctctcaggtcttttggactcaggaagtcacaactgaatgtccacaaatgactattaaggttaatggaaaaaatataaggggattaacagacactggagccaatgtttctattatttgttatagtgattggcctccctgcatggcctttaattacccagacccaaacaagttgaggagattaggagttcccactacagttcaaagtcagcagacctttcccaggtggaccaaaaggaaaaactgggttatctgaaaccttatgttgctgatatcccatcactttgtggggaagagatcttctgtctgccatgagacttaaaggaacaactaaggatgtctgttgtggcattctaatgattcttcccctggatggaaactaatgaaaaaattaggaaatcaaaaacaaacaggcttaggaaaaaacaaagtgcaaaagaacttataaacttgaccattaagcttgattaacatgggatagtgtttgataaggattttttaatagggaccattgaaaattctctgctagcccatgcagatgctatacaatggattaatgatggtgcaatttgagtagatcgatggcccctaactcaggagaaactgactaaaatacatgagctaatagctcagcaattgcaagcaggatctattgaggaaactaacagtccatggtatactcctatttttactattcctaaaaaatcaggtaaatggagactattacatgatttaagagaaattaataaaacaatgtatgctatgggagccttacaaccaggcttgccttcgactgcaattccatgagattgggctttaatttttatagatttaaaggattgttttttcaccataccattagcccctcaagataaatgtagatttgctttctctgttcctgctttaaataacaaagcgcctatgaaacatatcaatcaaatggaaagtattgccaaagggcatgaaaaacagccctaccatgtgccaaaaatttgtggattgagccttagctcctgttagacttaaataccctgaggcatgtattatccattacttggatgatactctcctctctgctccagaagaacaagtttttaacatcttgctagacactgaagtatatcttaatgaaaaggggcttaaataaaataaaataaaaaaaacccctccatttcaatatttaggaattttgatagaaggccatactattccgccacagaaattgcaaatttgcagggaccaattgaatatattaaaagattttcagaaattattgggagatattaattggctaaggccttatttggggattactacaaatcaattaactcatcttttaaaaacattaaagggcaatcctgaccttacctccccacatacattgtctccagcagccctcaaagaattacagctggttgaggaaaaaatagatgaggtacagttgcaagtattgattatgataattctattattctgatcctgttgccttccatacattcacctacagcagttctagttccagaaatgccacagtctggcattgtcaatggatccatctttctaatgaagaagtaaaaacaacaccactttatgtggacctcatagttaaggttattatccgaggcagatgccatcttaaaacaactggttggagcagatccaaatgttaaacatgtccctctagacaaatttatgagagaaactttactccaaacctcactgccatggtggactgccttagctggatatacaggggaacttgataatcatccacccaaaaataaacttatagaattcctacaagagacctcttttatatttccaaaagtcaccagatcacagcctattgctaaagctcttacttattttacagatggatcttcaaaagctaaagctggtattcaaagtctaaatatgactaaaattatacaaacttcttacacttctgctcaaaaagcagacctaatggctgttcaacaagtcttaaaaaataatctcatatccttgtaatattgtttcagattctcaatatgtggtacaattagtacaaaaactagaaacagcaaacttgaaagaactaaatgatgaagagttattccacctgttttttttgcacacaaattatgagacagaggacatcaccatgttttattaccccatatacgttctcatacttctttaccaggtcctttacatgatggtaatcaaaaggtggaccagcttatcatttctatttttgaaactgctcatgcttcacatgcacttctccatcaccctgcagcaatgctgcatagagtttagtctgtctcgcgctgttgcccaagatattattaaatcctgtccatcgtgtcaaagcttagcccaagtgtctaccaatgatggagtcaatcctagaggactaaaaagcaatcaactatggcaaatagatattactcatgttaatagttttggtcatttaaaatttgttcatgttactgttgacacatgcctgtcagctcaggcaggtgagacttttcaacatgtcaaaaaccattatttggaagcttctgctgttctggaccttccacaacatattaaaactgatactggtcctacttatgctagtaaggcttttgctgaattttgtcaaatttggggtattgtacatgtcactggcatcccttacaatccccaaggacaagctgtagaagaacatacacatcataaa

SEQ ID NO: 133 - DNA, 8941 bp, Artificial
  ss1145 sequence
tgtctgcttggggatgggggaggtccgggatgcttacatgggaaaatcaagaccttgtagtgtataaaagttactgagaacaaagacctggtgctcagactctggaggtgactcctctgagcccgcaccggtgctgaataaaccttgcttttccatatctccgagtgctgcttgtctccttccgttgccacagttttctgcggtttccgcaacattttggtgcgttggctgggaagctgacaaccgagctggcgttttgtgccaccgttgttggggaactgggggaggccacggtcgccggcccggtgacaggtggatagcgtgcaccggccattttgccggatccagaccctcactcgggctgtggccttggcctacaccgcttcccgaacggactcagaaggagagtggaaacagcttcctggacaggacgtcagactggtgagtgccccggggatatctgcccaagtcaggacccaccatatggtggaaggagagactgatcacctctcagtgaccaaagggtcactcaggtcagggtttgctcccttgggatcgggaggcttgccaattctggtgtgtgtgtgtgtgtgagtgactggagagaacaagagcccatgctccaccatctttggactacggagccagagtgagtcctaacctgcagttccacgatgaccctcatacagcttatggtggccctcttcgggggatcctgatgttggggtttatacagtcccacctatgctaagaggcgcctgaaatatctcctccaggggagcggtcaggcggaggaagcgattgttacctgaggccttgtcctcactgtttgtcttgcatcaccagcacagggtgggacttcacacaatgggtaaatcggcttccaagcccactgtcttagagtgtatggttaagaattttggagttcccgtcgtggcgcagtggttgacgaatccgactaggaaccatgaggttgcgggttcggtccctgcccttgctcagtgggttaacgatccggcgttgccgtgagctgtggtgtaggttgcagacgcggctcggatcctgcgttgctgtgcctctggtgtaggccggtggctacagttcctattcaacccctagcctgggaacctccatatgccgcgggagcggcccaagaaatagcaacaacaacaacaaaaaacaaaaagacaaaggcaaaaaaaaaaaaaaaaaagaattttaagaaaggattttctagagattatggtgttaagctgagtcctggaaaactgtgtaccctctgtaccctagagtggccctcctttggtgttggctggcctccagaagggaccttagatgtgttcacagttacaccagtatatagtgttataacaggagaccctggacacccagaccaatttccatatattgatcaatggttagaaattgcctatttgaggcccccatgggttcggttctgcaccacagaccagggacagtgtagggtgctagtagcccagtccaagaaaaagaccttgtctcaaaggaaggtgccacctatttatcaaggggaacctgatgactcgccccctatgccaccaccttatgtgctgcttgccccacgtccaggagccaaaggtccccagatgccagatagcccaccgccttctgtttcccttcctgcttctgcttctgaagttcccgaggcaatatcacccccacagccagattctccagaacctatgagcaggcatctccgttcagctcagggagcagccactccagcattacaaatgcccttacgggagacacggggaccacagcaagtcgcccctgatgggaccatacaagaggggggatgtttttattattaccagcccttttccactgccgatctcctcaactagaaacaccatactccctcatattctgaaaagcctcaggcgctgattgatctcttagaattcattttccagacacactgtcccacctggatagactgccagcaactcctttttactctatttgacactgaagagcgctggcgaattgtaacagaagcccaaaaatggcttcaggccaatgcggggggtcgagcagacttggcaaactgggtgagggaagccttcccagaagaaaacccccactgggactatgacactgaggaagggaaacgtaacctagagaggtacaggcaggccttcctacagggggcaaaagctggggctaaaaagcccactgatatagctaagatcagtgagatactacaagagccaaatgaaagcccaaccaaattctgtgagagactatgtgagtcttcccgaacctacaccccttttgatcccgaggcccctgagaaccaacggatgataaatgctgcctttgtgggacaagcccaatcagatatccgtaaaaagctacagaaattagaaggctttgcaggagagaatgccactaaactgttggaaatagcccacaaggtttttattaaccgagaccaggtggcccgccgtgatgcagaaaagagaatgaaacaaaaagtgactcttatggcagcctccctgtcaaaaccggtgcccccaatgggaccaccccgtaggggacaaggcacaaggccagggaaaaggagtcccctggaacatgaccaatgtgcttactgcaaagaaaagggacattggaaaatgaatgccccaaccgtcctgagaaaaagaccaaggccccacctagccggtaccgatctgagccattcagcaccaacctgatcagcctagctgagtctgattggggggaccaggctctctccaactgggcccccgagagcctatggtcagaattcaagtagggggccaccccatagactttatggttgacacaggtgccgaactttctgtggttacacagcctgtggctcccctctcggggaaagaaaccaccattgttggggccacaggtaaccaaacccacaggcccttctgcggtcctcgacgatgtcggttaggaggccatgaagtaatacatgaatttctttacctgcctgactgcccagtccccctgatgggaagagacctgctggctaaaaagggggcacaaatttccttttctactgacggattggcccaacttaaattgacagaacccccctctcctttaatcatggctcttgctgtaaaaagggaagaggaatggcgcttgtactctcccccttcagaaatggggaccattcccccgaactagagactaaatacccattggtttgggctgaaggaaacccaccaggactggcaaaactccacgctcctgtcttaattgatctaaaacccggagctcaaccggtaaagctatagcaatactcaattcccagagaagctcgactgggaatccaggttcacctggatcggctgcttcagcatggactgttaataaaatgtcagtccccttggaacacccctttactgcccgtgaaaaaaccgggaacacaggactaccgtccagtacaggacttgagagccataaatgaagcaacagtcacattacacctgtccgtccctaacccatatacccatattccactgctaagtggtttacttgcctggacttaaaagacgcctttttctgcctccaggtggcacctgccagtcagcccttgtttgcttttgaatgggagaatccacatacagggacaaaggaacagctcacctggactagactcccacaaggattgaaaaactctcccactctttttagcggcgccttagctgctgacctagctaaatttcctggacagaaactgggctgtgttttgctacagtatgttgacaacctcttactagctggcaccacggaggctcagtgcctagagggaacaagagctctcctttccctactgatggaggcagggtatcgggtatcaaagaaaaaggcacaaatctgcaaaaaaaacaagtcaagtatctgggcttcaacatcatgcagggccaacgaatgctggggactgaaagaaagcaggcagtttgtggcattcctgtccctaccacccgccggaaggtgagttcctaggggcagcaggattctgccggatatggatccccgggttttcagacctggccaggcctctgtatgaggctctaaaaggggaagaaaaggcactccttaaatggggaccaagccaggagacagcgtttcagacaatcaaaactaaactcactgaggctccagccttgggacttcctgatgtaaccagagaatttaacctttttgttcatgagaaaaatgggatggctttgggagtcttaactcaagaatttgggccttggcagaggcccagtggcatatctgtctaaacaaattgactcagttgctgccggatggcctccctgcctccgagcgctggcagctaccaccttgttggtaagagaggctgacaagttgaccctgggacaaaacctcaatgttaaagtcccacactcagttgtagccctaatggataccaagggccaccattggctcacacatgcatgaatgactcaatatcaagtgttactatgtgaaaatccacgggtaaaactggaggttgtacgaactctgaacccagccacttttctgccagatgaagcggggcccccagaccataactgcctggaggtactagatgaggtgttttccagcaggcctgactttgactgataaaccactccaaaatcctgacctggttttatatactgatggcagcagctttatggaggatggaaaaaggatggcaggatatgctgtggtatctgacttaaaagtgatagaagcagaggtgcttcctcaaggctggtcagcacagagagcagaattatgggccttaatcagagcactggaactcatccaagaccagcgagttaatatctataccaactcacgatatgcctttgcaactttacatgtccatggagccttatataaagaaagagggctcctcactgctgaaggaaaaggaattagaaaccaggctgaaatcttaaagctcctagaggcagtatgggaacctaaagaagttgcagttatccactgtaaaggccaccaaaagggggatgacccagtgacaaaaggaaaccatagtgctgatgcagctgccagacaggcagcctggggacaacagccagacaaacctaaggtcttgctggccccagaagtgccagctgtccccaaatattctccagaggaagaaaaacggataagggaggaaggaggaactaaaactaaaacagggtggtgggtcacatgggaccactgagtttacattccagaacagctggcctacaaactagtccgccaagaacatgagctaacccacatgggcaaaactgccttagagagcttactgggccagtactatctcattgctcgtcttcctgcactctgctcctctgtctcccaaagatgcataacctgtttacagagtaatgcccgccaggggccccacagaccagctggggcacagcactgcggactgtccccattcgaggatatggaagtggactttactgaggtctcccctagtaaggggtacaaatatttactagtttttatctgtactttttcaggatggatagaggccttccctacccgaactgaaaaggcaagggaagtaaccaaggcactcctgagagacattattcccagatatggaatgcctctgaccatcgggtcagataatggaccggcatttgtggctgaaacagtacaataggtggcaaaagctttacagatccgatggaaactacattctgtgtatcgccctcaaagttcagggaaagtagaacgcatgaaccgaagccttaaacagacactggcaaagttatgtcaggaaactggcttgccctggatagacatgttgccggtggccctcttaaaagtgagatgctcaccccgagcgggaataggattctcgccatttgaaatcttatatggaaggccacctccactaatcagtttaaaaggaaacaccagggagttgggagacttggaattacataaagaattacaaggactggggctcactatttctcggatacatagatgggtcacagacagaatacctgtgtccttaggtataacagtacacccccacaagccgggggaccaggtgtggataaaggactggaaaaaggagcctttgaggccggtatggaagggcccctatactgtaattctaaccacccccactgctcttaaagtaacaggaatagatgcttggatccatcattctagagtaaaaccggctggcacagctgacgaccttggagagtgggagactgccctcgatctggagagacctcttcgcctgacaatacagagaaggggacgacgatctcaaagccctgctctgaccacaccggaagctggtccgtcaacacacagctgaagcttgaggaatcggcagcctggtaaaataaactgccttacctcccttccacaagagactctctaactgtcatatactgttatcttatgaccaacatgtatgtttgctgcctgctactgttaatctggtcccctttggttctgtcaggatccatgtccttatgtgacccgtgcattcgagtgacctgatcagatcaaggggttacatggactttgctttactccactcgtttctcctgttccggagaaattcatggaagttgtactcacaacaggaccacttattctatctgtcaacagggggaccaatatacttgctttgatccacgatactcaccaactgaggaatggttagaagtccagcgctctcataagtcagggcagctaattaatcggacccaaattaccaaccccaagttgccagtgtcaatacttttcgatgcctgtgaagctatgaatgggtcatggacttctactagaccatgtggaagctcatcatgggaaagagaatataggctccagcataaatatatgtgctgggggaccacctggaatgattgcttggaatgcacttactggagctgtgtggcctgggcaactggaataagggagacaaaacagctgtccttcaaaagggtacagcccctccagactgccagactaaaacttgtaacccagttaatttcactattttcaattccagtgagcccaaatggaaggagggtttcaaaataagcattcgcattgacggaagaggccttgaccctggagctgtgttacatttccagagaatcacgtttgcgctccaagctgcctctcacagcatctttcattccttttatgaagaaataagaaacaccccacctcccattgtggccacaactaagaacttgttcttagccctggcagaaactattgcacaaactctcaaggtctcctcttgttatgtatgcgggggaacaaacacaggagaccactggccttggcaagccagagaactggacccattagagcctcctaatgagactgcatacccccaactcaccaatggggtatggctcctcagaactgctattatagggagaaattgtcttgcgaggtggggaggacggtttaatgtttcggtaggaagcttaacatgtttaggcctaaggtattataatctgactgcccaaaagactcaatggtggtcatcctccaatcactcagagcccaagcctaatcccttgtctaacttttcccaccttcaacaagcatgggaagatatcagtactaatatccagtggcgggcaccaaagggattatattggatttgcaaaaaatggcctattccatactccccccaaattgggctggggcatgtgtactgggaacaatcagaccttccttcttcctgctcccgctgtcactaggagagcaactgggagttcctatatatagggcacagggttcccagagagaccggagggctctccaaattggagagtggaaagatgatgaatggcccccagaatggataattcaatattatggacctgccacctgggcagaggatggctcttggggatattgcacccctatctatatgctgaaccgcatcatcagactacaggcagttttggaacttataacaaatgacactgcaagggccttgactatattggtccaaccacaaactaaaatgcacagtgcaatctaccaaaagcgcttggccttggattatttacttgcttctgaaggaggggtttgtggaaaatttaacttaagtaattgttgtctacaaatagatgatgctggaaaggtgatagaggaaattgctgaccgcatgactaaaccagcctgtacaaacttggaaaggatgggatgcagacagtctctttggtaaatggttctcttggttgggaggaattaagacaatggttggaatagtcatggttatactcgcagggtgcctacttgttccctgccttgtacctctcctgataaatattataaaaggttttataaaaaccatggttgaaagaaaaacagcctcccacctgctacttattagaggctatcaaagggttatgactgatgatgatctgtaaagggtgcagatgcgccctgaacatcaagaggggggaatgaaatagagttttagctaaagaacaaaccccccttggctaagaaggcagctgcaagcctttccagctgtgctaattactatgccacccttcttgtaataatgtaacaactgtgtgctctctgtccaagccagcagccctgctaatcaggtacccaacattgcttatcagttctgcttctgtaaccttgcttgctcagtttcttagggaggaacactgtctgcttggggatgggggaggtccgggatgcttacatggaaaaatcaagaccttgtagtgtataaaagttactgagaacaaagacctggtgctcagactctggaggtgactcctctgagcccgcaccggtgctgaataaaccttgcttttccatatctccgagtgctgcttgtctccttccgttgccacagttttttgcggtttccgca

SEQ ID NO: 134 - DNA, 3297 bp, Artificial
  ss1151 sequence
gttccccctccttatggggatcaattagaaggttctgtgttaaccctcagagcacaggagcctggtttggtgtcaccatctaagacctggcagggtacacaatctggaccaggagccacttccgcagcaggacagtttcccttgcatcaatatcctgtaggaggccttaatgtaaatgtccaatcagctgggtttctatggatgcacaagccatccttcagatttatttaactggaaaaaccataaccctacttaccaagaggatcccctccatgtgactcaacttttcactttgtatcttttccattcatcgtccctgttgggtagacagtcacactcatgaatatgatacttattagggatgaaaggaggatggtcattgacagggctaaataggaagcataccagcttcatctagaagatccagctggaactccagaagcaaatctggtgttgccattgctgagcctgactgggatcctcataatggggataggccacacctacagcactggaggaagtgtatcttagtgggtcttcgacagggggttccctaggcaaagcagatgaaccaaaattcaggagatacaccaaaaacccaatgaggatccatcagagttgctataaagaatttagcaagcttgaggcccctgaaaatatgagaatggtaaatatgactttcattgggcaaagtgccccagatataaggtgattgccgaagttggtgaatttggaacgaaccttctcaatttgtagatgttgcttttaaagtgttcaacagggaacaacggcagacacatgaggatgcaagatggagtgctacttttctggcagcagtattggcttccccgaaggcaagtaatctgaagagaggtgagccaccatctgggagcgcacaatgtgcttattataagtaggaagtgcactggaaaagagagtgccctgggctaaagaataagatgaaaatcagtaaaaaaaaaaaaaaaaaaaaaaaaaaagatgggatcctctcatatggtaagaagagaggaagactttgatgaggaatgaagaggcccaggggctcccttggacttgaggcacccaattgcaatttccctgcaggagccctgggtaactttgacagtacaggacaagttgattgactttctaatagacacaggtgcaacatactctgtggtaaatcccagggtggcacagaaaacatcccaatccatcccagttataggagtttctgaagaagtacaaagtcattcttcttacaaactctagaatgccaattagagaacctcaccctgaaatacaatttcttatgtttgccaccatgtgcaatccctcttctgagccaagatcacctttgtaaattaaaagctcaactttttcaccagaagagcttgacctcagagtcccactggagcacactttgaacctacagatggcactcatggatgccccagaggtctacgaagaggtaagtccagaaatgtgggcagatggcaccccagggaaggccaaaaacacctggccaatacaaaaagggatgctgggacacctagtctaaaacagtatcttctaaggtaagaggcctaaagggaattcagccaattctcaaaaagtttttgaaaccaggattgattaaaccttacagatccccatataacacccctatcctcctggtaaaaaagccaaattcagcagagtatcgttttgtccaagactcgagggttattaatgaaatagtccaagattttcaccctgaggtacctaatctgtacactttactcacaactattctgggagaagacagctggttcttggttttagacttgaaagatgcttttttaggcattcctgttgcagaagaatcacagcagctgtttgcctttgaatggcaggacccagaaacacaggtagtccaacagtattgttagacagtcctgctccaaggatttaagaattcccctaccttgtttgggaaaatgctgtccagggaccttggaaacgtaatattggacaaaggatgcattctctgtggtgcacactaatggggcaatctggaaagaaagggggctcgtcacatccataagccctcacagtggccatgatgcactgcccaggccaccaaaagggtgaaactcatataatacaaggcaactggttagttgaccaagctgcaaagaaggcagcaaaggaaggcaattatcaagccaggatagggtcacttctcccacagactgacttgtcaaaataccagccagtatattcagaaaaggacaaggagagggccgaagagtggggactgaccacgcctcgcctggctggaaatgtagtgcgtaggaattgttttggtccttggggccttcttggaccctgtgctatagcacattcataatagtacccattacaggagagaggccaccttgtaatggattcaaaaatacataatggggcctaacctacaaatgactatccagcgagccactcaaaactgcatgatttgtgctaaaaatgatccaaagcctgctgcgaggcctccccagatggggacctaacacagaggaacctgcccctcagaagaatggcaaatagactttacccaattgctttgagccgcaggagatttcaggtaccacgctagtatttgtggacactttttcgggatgggtggaggcatatcctaccaggacagaaaaagcctccaaagtggttaaagccctccctaaggaaatgatcccctgatttggactacctaactcccttcaaagtgataatggacttgcttgtgtctctagcataacccaataaatatctaaagcactgcaaattaattgggtgctacattcatcctagagaccccaatcaacaggaaagactgagaaaatgaaccatacattaaagaggagcattgctaaaatatgttaagagactaatttaacttaggataaggcctggccgcttgccctgttatgggtcagagtggctcccagaagcagtcttaaattaagcccctttgaaatattgtatggtaggccgttccagatgtctcctcagtcagggaaatctataaatgtgctgaaagatctagcagttgccagttatgttagaactctgagcattatactaacctctgttcatgagtttgcatccagcaggtctgcctatccaactgaggtaaccttacatcctttccaacctggagatcacatccttcttaaagcctggagagaagaagggcctgagcaccagctgactgcaaggtggacaggactacatgtggtgttaccacgcactcatcta

SEQ ID NO: 135 - DNA, 8697 bp, Artificial
  ss1152 sequence
tgtaccctacatccaagccagcagccctgctaatcctgttcccagcattgtttatcagttccacttctgtaaacttgcttgctcagtttcttagggaggaacactgtctgcttggggaagggggggccggtgggtccaggatatttacatgggaaaatcaagaccttgtaatgtataagagttgctgagaacaaagatctggtgctcagactctggaggtgactcctctgagcccacaccagtgccgaataaactttgcttttccatatttctgagtgccgtctgtctccttctgctgccacgttttttgcggttcctgcaatattttggtgcattggccaagaagccgacaactgagctggcctcttgtgccaccgatgttggggaaccgagggaggccatggttgttggcccggtgacaggtggatagtgtgcaccggctattttgctggatccagacccctactcaggccaagctggccttagctcacaaccacgtcccgaatggactcagaaggagagtggaaacaggttccaggacaggacatcggactggtgagtgccccggggacatctgcctgagtcaggacccaccatacagtggaaggagagactgatcacctctcagtgaccaaagggtcactcaggtcaggatttgttaaccttgcgatcgggaggcttgtcaattctggggtgtgtgtgtgtgtgtgtgtaactggagagaatgagagcccatgctctaccatctttggacgatggagccagagtgggtctgaacctgcagttccttggtgaccctcacatggcttatggtggccctcttcagagggatcctgatgttggatcccacctatgctaagaggtgccagaaatatctcctctgggaagcggtcaggtggacaaagcaactgttacctgaggccttgtcctcgctgtttgtcttgcatcaccctcacagggtgggacttcacacaatgggtaaatcggcttccaagcccactgtctgagtgtatggttaagaattttaagaaaggattttctagagattatggtgttaaactgagtcctggaaagctgtgtaccctctgtaccctagagtggccctcctttgatgttggatggcctctggaagggaccttagatgtgttcatggttggagcaatatataacgttataacaggagaccctggacacccagaccaatttccatatattgatcaatggttggaaattgcctatttgaggcccccatgggttcggttctgcaccacagaccagggacagtgtagggtgctagtggcccagtccaagaagaaaccttgtcttgagaaaaggtgccacctatttttcaaggggaaactgaggattccccctctatgccacctccctatgtgctgccagcctcacctctgggagccaaaggtccccagatgccagatggcacaccaccttctgtttttcctcctactcttgctgctgaagttcttgaggcaatatcacccttgcagccagattctccagaaccaatgagcaggcatctccagtcagcccagggagcagccactccagcattgcaaatgcccttgcaggagtcatggggaccacagcaagtcacccctaatgggaccatacaagaggggggatggcttttttattaccagccattttcactgccaatctccttaactgaaaacaccatactccgacatagtctgaaaagcctcaggcactgattgatctcttagaattcattttccagacacactgccccacctggctagactgccagcaactcctttttactgtttgacactgaagagcactggtgaattgtaacagaagcccagaaatgccttcagacctatgcagggggttgagcagacctggcaaactgggtaagggaagccatcccagaagaaaacccccactggcactaggacaccgaagaaggggaaacatcatctagagaggtaccggtaggccttcctgcagggggcaaaagctggggctaaaaggcctactaatatagctaagaccagtgagatactacacgagccaaatgaaagcccagccaaattctataagacactatgagaggcattttgaatctacaccccctttgatcccgaggcccccgaaacccagtggatgataaatgctgtcttcgtgggacaagcccaatcagatatccataaaaagctatagaaattagaaggatgtgcaggaaagaatgctatggagctgttggaaatagccaacaaggtttttattaaccgagaccaggtggcctcgcgatgcagaaaagagaatgaaacaaaaagtgacacttctggcggccgccctgtcaaaaccagtgccgccagtgggaccaccccataggggacaagttctaaggccagggaaaaggagtcccctggaacgtgatcaatgtgcttactgcaaagaaaaaggacactggaaaaatgaatgtccggttggtcaaccatcctgagaaaagaaccaaggccccacctagctggtacccatctgagccattcagcactgacctgatcagcctagccaagtccaactaggggggaccaggctctctccaactgggcccctgagagcctatggtcagaattcaagtagggggacaccccatagactttatggtagacacaggtgccaaactgtcagtggtcatgcaacctgtagctcccctttcggggaaagaaaccaccaccactggggccacaggtgaccacaggcccttctgtggtccctggtgatgccaattaggaggccatgaagtaatacttgaatttatttacctacctgactgccccatccccttgatgggaagagagctgctggctaaaatgggggcacaaatttccttttccactgatggattgacccaactcaaatgaacagaattcccctctcctttaatcatggctctcgctgtaagaagggaagtggactggcacctgtactcttccccttcagaaatggggaccattcccccagaactagagacaaaatacccattggtttgggctgaaggaaccccaccaggactggcaaaatgccacgctttctatcttgactgatctaaaacccggagctcaactggtaaagctatggcaatagtcaattcccagagaagctccactgagaatccaggttcacctggataggctgcttcagcacggactgctaataaaatgtcagtctccctggaacacccctttactgccctgtaagaaaactgggaacaccagactaccgcccagttcaggacttgaaagccataaatgaagcaacagtcacaatacacccgtctgtccctaactcgtataccctgctagggctgatcccctccctgctgagtggtttatttgcctggacttaaaagatgcctttttctgcctctgggtgatgcctgccagtcagcccttgtttgcctttgaatgggaaaatccacatacagggacaaaggaacagctcacctggattcaaaaactcccacaaggattcaaaaactctcccagtctttttagcggcgccctagccactggcctggctgaatttcctggacaaaaactgggctgtgttttgctacagtatattgatgacctcttactagctggcaccacgcaggctcagtgcctagagagaacaagagcgctcctttaccctactaatggaggcagggtatcaggtatcaaaaaaaaaaaaaaggcacaaatctgtaagaagcaagtcaagtatctgggctttaacatcatgcagggccgacgaatgctaggaagtgaaaggaagcaggcagtttgtgccattcctgtccctaccaccctcgggaaggttggtgagttcctaggggcagcaggattctgctggatatagatccctgggtttttagacttggccaggcctctgtatgaggttctaaaaggggaagaaaaggctccccttgcatggggaccaagccaggaggcagcatttcagacaattaagaccaaacacactgaggctccagccttgggacttccttttatcatcagagaattcaacctttttgtttgtgagaaaaatgggatggctttgggagtcctaacccaagaattcaggccttggcagaggccggtggcatatctgtctaaacaaattgactcagttgtggccggatggcctccctgcctccaagggctggcagctaccaccttgttagtgagagagtctgacaaggtgactctgggacaaaacctcaacgttcaagtcccacattcagctgtaaccctaatggatacgaggggccaccactggctcatgcacacatgaatgcctcatatgtgaaaatccatgggtcaaactggaggttgtatgaactctgaacccagccacttttctgccagatgaattgggacccccaagaccataactgcttagaggtactagatgaggtgttttccagcaggcctgacctgatggataagccactccaaaatcctgacctggttttatatactgatggcagcagctttatggaggatggaaaaacaatggcaggatatgctgcggtatctgacttagaagtgatagaagcagaggtgcttcctcaaggctggtcagcacagagagcagaattatgggccttaatcagagcactggaactcagccaagaccagcgagttactatctataccaactcatggtatgcctttgcaattttacatgtccatggagccttgtataaagaaagagaactcctcactgctgatggaaaagggattaaaaaccaggctgaaatcttaaagctcctggaggcagtatgggaggctaaagaagttgcagtcatccactgtaaaggccacccaaagggagacgacccagtgacaaaaggaaaccatagtgctgatgcagctgccagacaggcagcctggggacaacagccagacaagcccaagctcttgctggccccagaagtgccacctgtccctggatattctcaagaggaagaaaaatggatgagggaggaaggaggaaccaaaactaagatgggatggtgggtcccatgggaccaccaggtttatgtcccagaagagctagcctacaaactagtccaccaacaagataagctcacccacatgggcaaaactgcctcagagaccttactgggccggtactgtctcattgcatgtcttcccgcactcagctcctctgtctcccaaagatgcataacctgtttgcagaataatgcttgccaggggcccagcagaccagctaggacacatcactgtggactgtccccatttgaggatctggaagtggactttactgaagtctccccaagcaaggtgtacaaatacttactagtttttatctgtactttttcaggatgggtagaagccttccctaccctaactgaaaaggcaagagaagtagccagggcacttctgagagacattattcccagatatggaatgcctctgaccatcaggtcagagaacggaccggcacttatggccgagacagtacaacaggtggcaaaagtcttacagatccgatggaaattacattctgcttatcgctttcaaagttcagggaaagtagaacgcatgaactggacccttaaacagacactggcaaagttatgtcaggaaactgacttgccctgggtagacatgttgccggtggccctcctaaaagtgaggtgctcgccctgagagggaatagggttcttgccatttgaaatcttatatgggaggccacctccactgatcaatttaagaggaaacactaggaagttgggagacttggaattacacaaacaattacaaggactggggctcactctctctcagatgcatggatgggtcacagatagaatacctgtgtccttaggcattaacagtttacccctacaagccagggggccaggtgcagataaaggactggaaaaaggagcctttgaggctggcatggaagggcccctatactctaattctaaccacccccactgctctcaaagtaatagatgcttggatccatcattccagagttaaacccgctggcccagctgatgaccgtggagagtgggagaccgcccttgatccagagagacctcttcgcctgacaatacagaggaggagacgacgatctcaaagccctgctctgaccacaccagaagctggtcagtcaacgcacggctgaagcttgaggaatcagctgcccggtaaaataaactgccttatcttccacacgagactttcttactattatatactgttatcttatatccaacatgtatgtatgttgcctgttgctgttaatctggtcccccttggctctgccaggacccatttccttatgtgacctatgcattcaagtgacccaatcagatcaaggggttacatggactttgctttcctccactcatttctcctgtcccgggagaaattcaaggaagttgtacccccaacaggcccacttattctatctgtcagcagtgggaccaatatacttgctttgatccttaatactcaccaactgaggagtggttagaggtctggcgctctcataaatcagggcaactaagtaattggacccaaattaccagccctgagttgccagtatcaatactttttgatgcctgtgaagctatgaatgtgtcatggacttctactagaccatgtggaagcccatcataggaaagagaatataggctacagcataaatatatgtgctgggggaccccctggagcggttgccaggaatgcacttactggagcggcatagcctgggcaacctgggataagggagacagaacagctgttcttcagaagggtacagcccctccagactgtcagactaaaacttgtaacccagtttaatttcactattttcaattccagtgagcccaaatggaaggagggtttcaaaataagcattcacattaagggaagaggccttgaccctggagctgtgttacatttccagagaatcacgcttgcactccaagctgcctctcacagggtctttcattccttttatgaagagataaaaaacactccaccattccggccacaactaagaaaacttgttcttagccctggcagaaactattgcatgaactctcaagatctcctcttgctatgtatgtgggggaacgaacacaggagacctttggcctcggcaagccagggaactgaacctgttagagcctcataatgagactgtatacccccaactcaccaatggggtatggctcctcagaactgctgttatagggagaaaccatcttgtgaggtggggaggatggttcaaagtttcagtcggaagcctaacatgtttaggccgaaggttttataatctgactgcccaaaagactcagtggtggtcatctccagcctctcagagcccaggcctaatcccctaacttttcccacctccgacaggcatgggaggatattagtgctgatatccaatggcgggcaccagagggattatattggatttgtggaaaaatggcctattccatactccccccatttgggccggggcatgtgtactgggaacaatcagaccatccttcttcctgctcccattgtcactaggggagcaactgggagttcctatatatagggcacagggcgcccagagagactgaagggctctccagattggagactggaaagatgatgaatggcccccagaatggattcaatattatgggcctgccacctgggcagaggatggctcttggggatatcacacccctatctctatgctgaaccacatcatcagactacaggtggttttggaacttgtaacaaatgacactgcaagggccttgactatattgaaccaacagcaaactaaaatgtgcaatgtcatctaccaaaatcgctgggccttggattatttacttgcttctgaaggagaggttggtgggaaatttaacttgagtaattgttgtctacaaatagaggatactggaaaggtgatagaagaaattgctgaccgcatgactaaacttgcccacgtgcctgtacaaacttggaagggatgcagtctctttggtaagtggttctcttggttgggaggaattaagacaatggttggaaagatcatggtcatactcgtggggtgcctacttattccctgccttatacctctcctgataaatattataaaaggttttataagaaccacggttgaaagaaaaacagcctcgcacctgctacttatcagaggttaccaatgggtaatgactgatgatgatctctgaagggtgcagatgcaccctgaacatcaagaggggggaatgaaataagagttttaactaaggaacaaccccccccccccatctaaaaaggaagctgcaagccttttcagctatgctcgcctcataccacccttcttgtaataacgtagcatctatgtgccctacgtccaagccagcagccctgctaatcctgttcccagcattgcttatcagttccacttctgtaaccttgcttgctcagtttcttagggaggaacactatctgcttggggaagggggggcgggcgggggagtccgggatgcttacatgggaaaatcaagactttgtaatgtataaaagttgctgagaaaagagacctgctgctcacactctggaggtgactcctctgagcccacaccagtgctgaataaaccttgcttttcca

SEQ ID NO: 136 - DNA, 8863 bp, Artificial
  ss1167 sequence
aaggcaaatatctatggacacagagttctaaagtacagagtctccttcaaagacaagataaagaaggatttatgcattaaccatgttattctatgaacagctgcactatgtcctaaggatatcccctttgatatcactaagaagataacctcttgatattgcctatgcctgttcctgccccctagtcttgtcaccttccttaatcccactaataataatctcatcaccttctttaataaaagtcatgtgggctaaagcctaggtgcctttgttctgaggaacagagtgccccctggtcccccagtttctaagtgtaagagtcttgtgtattttgttattctgtgccatcgctcttccagggttccctgttgccctgaagcactggatgcagcagagtgacacccaacatggggccggaagagaaggtctgccatgagcaggaaaaggtgaaactacagatggcgagatggtagccttgcactcgacagagttgccactgggagtaggcaagtagaaactttaaaccaggtaacaatggggcagaatcaatcacagaaaactaaacattatattcaattgcttaaatgtatgttaagacagtcagaggttcaggtaacagagtctgagatacaggaattgttagaagatgtgatcaaatataacccttggtttccagcgagggtactgtggacccagaatgttgggatcttgtgggggaaaatttaaagcgtgcccatcggtctggggcttctcttcctgtttcttttttttctatgtggtgactagtaaaacatgctttggaacctttgcaggagcattagggaaagctccacctcggactgatccctttcttgatgagagtttaaataagcctgtagctgtggaggaaacattaactccccctcaatcagccctaaaatctgtgagtttagaagatcagacctttttagcatgccctaaaactactacccccaatcctcaagtcccaggacaaaatatccatatgcataacccttttgattttagagctcttaaagctctttgggagagtgtactacagaatggagttacagctccttttactatgagtatggtagaaagtatggggacacttcagcttcccccatgggattggcatatgatagctaaaaccactctagatggtggggactatttaatttggaagtctagtctttcagatttttgtcaggaacaggcttgcttaaatcaaagaaacaatgttccaattactttttttttttttttttgtcttttgtctttttttgttgttgttgttgttgttgctatttcttggttcttgggccgctcccgcagcatatggaggttcccaggctaggggttgaatcggagctgtagccacccgcctacgccagagccacagcaacgcgggatccgagccgcgtctgcaacctacaccacagctcacggcaacgccggatccttaacccactgagcaagggcagggaccgaacccgcaacctcatggttcctagtcggattcgttaaccactgcgccacgacgggaactccccaattacttttgaaatgttggttgggactggcccttttctcgacttagcaaaacaactgacttacggatccttgggcatatgagcagctgagcctggctgcccaaagagtgtggatgacaattcctgagaaaggaaatccacaaagatctttcgtacagtgccttcaaaggccctacagagccttacccacagtttgtggactaactcgagcgcgggtatgtcaccaagtagcacattctcaggcagctgatattttaattaaacaattggcatacgaaaatgcaaataaagactgtaaaagggcaatggcccctgtaagaaatctgggaggcatctctgattttattaaggtgtatcaagatgctgcagcattaaaaggaatgcttagcagctcaggaaagaaatgttttaattgtggaaaaacaggacattttcagagagaatgtcaagctcaattaaaagagaaatcatccctagcaatgggatcatctctaggacctagtcataactctggtttatgtccttgttgtcagaaaggaaatcactgggctaatcaaagtctgtttcatcaaaaacggcattccattaacaactccagtgcccgtcaaccagtgagggcatttatggctcaaaccgaataggaatccaatcccttaaaagggctactcctggcagtgtcagtgcagggttggatttactctgcactacagcagcagttttaacatgtgaacagggcattcaggctcttccaactggaatctatggcctttttcctcctaacaccataggccttattataagaagaaatggcctaaccttgaaagttttgcctggggtgatagatgcaaactatcaaggagtgattaaggtaatggtgaaattgaaaccatacatacattgcaacctggaatgaaaattgttcgactgttaaaatcttaaaataggacagagttgccagaaagaaaggggaacatcaggatttggaagttcagggacttctaaggtcttttggactcaggaagtcacaactaaacatacacaaatgactattaaggttaatggaaaaaatataaggggattaacagatattggagtcaatgtttccttatttgtcatgattggcatccaacatggcctttaattacccctgaaatgaagttgaggggattaggagttccaactactgtccatcaaagtcagcaatgctttcctgggtggggccagaaggaaaaatgtgttattttaaaccttaggtttgctgatatacccttcactttatggggaagagatctgtctgctatgagacttaaattaacaaccgaggatgtctattgtggcaattctaatgattcttccctaagatggaaactaatgaaaaaattaggatatcagaaacaaacaggtttaggaaacaataatcaaggcgtaaaagaaccaataaacttgcccattaagctgaataaacatggaataggatttgatgaggatttttaatagggaccattgaaaattcttgctagcccatgcagatcctatacaatggattaatgatgatccaatttgggtagatcagtggcccctaactcaggagaaactgactaaaatacatgagctaatagctcagcaattgcaagcaggacatattgaggaaactaacagcccatggaatactgctatttttactattcctaaaaaatcaggtaaatggaggctattacatgatttaagagaaattaataaaacaatgtacactatgggagccttgcaacaaggttggtcttctcctactgcagttcccttagattgggccttaattgttatagatttaaaagattgttttttcaccataccattagcccctcaagataaacgtagatttgctttctctgttcctgctttagataacaaagtgcctaagaaccatatcaatggaaagtattgctacagggcatgaagaacagatctaccatttgccaaaaatttgtggatagagccttaactcctgttagacttaaatatcccaaggcctacattattcattacatggatgatattctcctctctgctccaaaagaaaaaacaagtttttaaacatcttgctagatactgaagtatatcttaataaaaaagggcttattataaccccagataaaattcaaaagacccctccatttcaatatttaggaactttgatagaagaccacactattcggccacagaaaatgcaaattcgcagggaacaactgaatacattaaatgattttcaaaaattattgggagatattaattggctatgactttatttaggagttactacaaatcaattaacttatcttttcaaaacattgaagggtgatcctgacttcctgaccttacctaactgttgtctcctgaagccctcaaagaattacagctggtagaggaaaaaataaatgaggcatagttgcaacttattgattatgataatcctattattctgatcatgttgccttccataaattcacctacagcagtcctagttcaggaaatgccacagtttggcatttggatccatctttctaatcaaaaagtaaaaacggcaacactttatgtggacctcatagctaagattattatctgaggcagatgccgtcttaaacaattgactggagtggatccaaatattatacatgtccctctagataaattcatgagagaaactttattctaaaccttgttgccatggcagacggctttagctggatatacaggagaacttgataatcatccacccaaaaataaacttaaaaaattcctacaagagacctcttttatatttccaaaagttatcagatcatggcctattgctaaagctcttacttattttacagatggatcttcaaatggtaaagctggtattcaggtccaaatattactaaaattatacaaacttcttacacgtcagctcaaaaggcagaactagtggctgttcaacaagttttaaaaataatctcatatccttgtaatattgttttagattctcaatatgtggtacaattagtataaaaactagaaacagcaaaattgaaagaactaaatgaagagttatttcagctactttttttgcacacaacaaattattggacagaggacattactatttcttattactcatatatgttctcatacttctttaccaggtcctttacatgttggtaatcaaaaggtggaccagcttataacctctatcttttaaactgctcgtgcttcacatgcacttctgcatcagcccacagcaatgctgcgtagacagtttagtctgtctcatgctgttgcccaagatattattaaatcttgtccattacgtcaaagtttagcccaagtgtctaccaatgatggagttaatcctagaggactaaaaagtaatcaactatggcaaatgtatattactcatattaatagttttggtcatttgaaatttgttcatgttattgttgacacatatacctctgtgctatgggcctcagctcaggcaggtgagacctttcgacatgtcaaaaaccattgtttggaagcttttgctgttttgggcctttaacagcatattaaaactgataatggtcctgcttatgctagtaagactcttgctgaattttgtcaaattgggtatgtcactggcatcccttataatccccaaggacaagctatagtagaatgagcacatcataaattgaaactccaacttaaaaaacaaaagggggaacaagaaggctccttcccacaagattagttaagacaagcttttcttgctttaaattttttcacctgtagtgaacaaggaataatgcccatggaaaggcactatggccagcttattcctggtacctcaccattagtatattggaaaacacctgaggaaaatatatggaaaggccctgatcctttaataacttggggaagaggttatgcttgtgtctttccagaaacagtggctactacacttttttgggttcctggcaggtgtgtgaaacagtggcatggaggaagaccaactgacatgcgacttccaacgaatgacactgggagcatagggtcaacataatgctacattaggtattctggctttataaaaggacaggccacttttgaagtccattttataagccaggcttcccctaatagacaaaaactacaaaaattagaacaggccccacaaactccattcctggtcttacttgacatggctttaaggtttcagggaagagtcttgttttacacatttgtaccttattcatacctgaagcttcagaatggaaaatatgaggtctttgttttgcttctttgtgttgtatatgtatggcattgccaaaataaatccataaaagagctctaattagttgccttaaaggaaattaagcacttacataaattctcaaaaaacataaattaatttttggttcacatgaactggaaaatattcagtatttgatattcattattagatgttaatatttgttgatctaattaatatagacatgtctttagagtcatcaacattaagtaaaataccttattgtacctaggtttaataaaggaatgtaactgtattttattaaaagggaagagtctgtcttatagcttgttattttgaatggaaagatgggggacagagtaatagggatacagaaagtgatggagggtttgtgggaagtggacaatgaaaaaagaattttgtgcatggttggggctaagttgaaaatttcagtaaactaattttaaaagtaagctagtgcaaaacttgaatttggatatgggctctattaaaaaaaggttttcttagggctatgggaaatccaagacgggccgcttggttcttcccagttccctggcaatcccaataatgaaaaagaaatgcttagaaaacatgtttttccatttggggaagactttctacagtcctaatctggctatatttggtaaaaatgagggtaattgtaaagagagtgctttgattcatattccagttttgtatattaagattactgtttatactgtttaaaactcacctccctaatagttgtttgccgctatgttacattattataaactttaactgaattattaagaaaaataatctaagattgtttctgaagctgattggtgtaatctgtctctggacaaatatcagacgtcccatgataaccaggggaatacatatacattctggaaaagtatcatttaaaagcttgtctccagcctagattaaaaagtttcttctcaggagttaagtgccatgtgaaggggtgaagaaaattaactcttaaatttatatttctcatttaagaagggcctctgtattggactggtctatggagagaactactgaacttctaactcaccctaaaacaagactctaataagaaaaacaccaatgcatggacaaaaagaagacaacatcagaaggagttcactatcccaagactgtcacctgacttgtatggttatttgttttacttctgatttaccctggtgggtttctcccctccaaggttcttattattgatgttactaggtgggaccctctcacctggctgacccagaccataaatacattttcatctaatgcaattttaagttaagctcttaacttaaaattttgattatgactttactaatactgctatctatattttattaactgttttcacaaaattgctatttctcacattgctgaatttgtagctaagtctctgataaaatgatatacagttccatatgaggtcagtgatctctagatatgggaaaatgcaacaagagggaatattttcctggaccataatagactaggaagataggtggtccagagacttttggctactgttaataaggcctagtccagtagcagtatattgcgttgcttatcagtgaaatctttgctagatctgggaatattcattcctagcaccgtgggatgaaatggtcatgatatgccttcccaaactatggtagaatatatgaccatgggtgagcactgtgaactgaaatttggcacttggcatcagcctctacatggagtaaaacatgagctactgcagctgccaacctgcagcaccccctgagtagaacttagcatggaaaccaggaatgaggcactctgtgctctgggaaaactgacggaacaggccctcagataattagattttaggtaaggatttcatgggcccaaattcttgcatcttctcttgtctagaaaaacagaaatcatcatctgcactggccattagaaataaaaggcagaatggagcagctgtgggacagacatccaaggtaatagtaggaaatattatgggagtaattttagacaagtctttatattgctaagaacttaaggtttatgtgtcctgtcagacttgatgctaccagctgctctcaaagcaacatcagctggcagctgcaaccttacattttaaaggtgtcctcttataacaacagaaaggtgacatgtataaggaccaatagttcctgttatttaaaactacactcctccttcaacagtaccatatcaatctaaattccaaacctctgtttaatctcatttttttcttcccatcatccatagtaggaacctaccatgtccagccactcagtactcgtcgccccaaccagcaggaagtagctacagaagagaggactgtcgccccatcccatataaaaaaagcgctggattaataggttcccaggaagatggagaccgacctccaccccctgaacgtgactgttcaccttggagacctgctgtggacatggtctgcagaatcatggattggtccctagaaacctaatgaatgccctacaatcaaaatttataatgactgtccttatgcaacaaataaataaaaaagggggagatgttggagaccacagaacagctgaattctgcagaaggcaagtatttatggagttccaaaggacagagttctaaaggacagagtctccttcaaagacaagataaagaaggacttatgcattaatcatgttattctatgaacagctgcactatgtcctaaggatattccctttgatatcactaagaagataacctcttgatattgcctatgcctgttcctgcccgctaatcttgtcaccttccttaattccgctaataataatctcatcaccttctgtaataaaagtcatgtgggctaaagcctaggtatctttgttctgcagagcagattgccagattgtcacctggtccctcactttccaaatgtaagagtctgtgtattttgttactctgtgccatccctcttccaggattccctgttgcc

SEQ ID NO: 137 - DNA, 8828 bp, Artificial
  ss1175 sequence
tgctaatcatattcctagcatttcttatcagttctgcttctgtaacctttcttgctcagtttcttatggaggaacactgctcaggaaagcagggagatcctggggatgcttacatgggaaaaacaagactctgtaatgtataaaagttgctgagaacaaagacctgctgctctgagtctggaggtgactcctctgagccaccagtgcttagtaaaccttgcttttccattatttccaagtgccatttgtctccttccactgccacagtttttgcagtttctgcaacattttggtgtgccaccattgttggggaaccggggaaggccacagtcactggcccagtgacaggtggatagcatgcaccagccattttgccagatccagaccctcacttgggccatgctagtgtgcttggctcacactgcttcctgatttgactcagaagagagaagaaacaggttccaggacaggatgtcagactggtgaatgcccctgggacatctgcctgagtcaggacccaccacatggtggaaggagagactgatcaccactcagtgaccaaagggtcacccaggtcaggatctgttcccttgggattgggaggcttgtaaattctagtgtgtgtgtgtgtgtgtgtgtgtgtgtgtgtgtgtgtgtgtgtgtgtgtgtgagtgactggagagaatgagagcccatgctccactgtctttggactacagagccagagtgagtcctaacctgtagttccttggcgaccctcatatggcttatggtggccctctttagagggatcctgacattggggtttatacagtcccacctaagaggtgcctgaagtatatcctctgggggagcagtcaggtggacaaagtgactgttacttgaggtcttgtcctcgctgtttgtcttgcatcacagtcatagggcagaacttcacacaatgggtaaattggcttccaagcccactgtcttagaatgtatggttaagaattttaagaaaggattttctggagattatggtgttagactgagtcctagaaaactgcatacactctgtaccctatagtggccctcctttggtgtcaggtagcctctggaagggaccttggatatgttcccagttggagcagtatataatgttataatgggagaccctggatacccagaccaatttccatatattgatcaatggttgaaaaatgcccatttgaggcccctatgggttcagttctgcaccacaggccagggacagtgtagggtgctagtggcccagtccaaacagaaaaccttttctcaagaaaaggtgccacctatttttctaggggaaactgaggactcaccctctttgcgacctccctatgtgccgctggccctacctctgggagccaaaggtgcccagatgccagatagcccaccaccttctgtttctcctcctccttctgctcctgagtttcccaaggcaatatcaaccccacagccagattcaccagaactgatgaacagatgtctccagtcagcacagggagcagccactccagcattgcaaatgcccttatgggagacacagagaccacagcaaattgcccctgatgggaccatacaagaagggggatggtttttttattaccagcccttaactgtatctccttaactggaaacaccatactccctcatattctgaaaagactcaggcactgatcaattgcttagaattcattttccagacacactatcctacttggatagactgccagcactgtcctacttggatagactgccagcaactcctttttactctgtttgatactgaagaatgctggcaaattgtaacagaagcccagaaatggctttaggccaatgcagggggtcaagcagacatggaaaactgggtaagggaagacttccaagaagaaaacccccactgggactgtgatactgaagaagggaaatgtaacttagagaggtactggcaggtgttcctacagggggcaaaatctggggctgaaaggcctactaatatagctaagacctgagagatacaagagccaaatgaaagcccagccaagttctatgagagactatgtgaggcttttcaaatgtgcttaccacaaagaaaaggaatattggaaaaatgaatgccccatctttcctgagaaaaggaccaaggccccatgtagccagtactgatctgagccattcagaaccaaactgatcggtctagctgagtcagattaggggggaccaggctctctcaaactgggcccccaagagcctatggtcataataaagtagggggccaccctgtagactttatggtagaaacaggggtcaaactttcagtggtcatgcaacctgtagctccactcttggggaaagaaactaccatcattggggccacagacaaccaaacccacaggcccttctctggtccctggtgatgccagttaggaggccataaagtaatacatggatttctttagctgcctgcgtgtctggtccccttgatgggaagagacctgctggctaaaatgggggcagaaatttccttttccactgatggattggcccaactcaaattaacagagtccccctctcctttaatcatggctttcactgtaagaagggaagaggactggtgcctgtactcttcccttcagaaatggggaccattctcccagaactagagactaaatagccattgatttgggctgaagggaacccaccaggactggtaaagctccatgcccctatcttgattgatctaaaccctggagctcaatcagtaaagctacagcagtagtcaattcccagagaagctcaactgggaatccaggttcacctggacaggctgtgtcatcacagactgttatgaaaatatcagtccccctggaacacccctttactgcccataagaaaacaaggaacacaagactactgcccagttcaggacttgagagccataaatgaagtcacattgcaccagtccatccctagcctgtataccctgctagggttggttgatcccctccactgctgagtggtttacttgcctggacttaaaacatgcctttttctgcctccaggtggtgcctgctagtcagtccttgtttgccttcgaacgggaaaatccacatacagggacaaaggaacagcttacctggatgagactcccagaaggatttaaaaactctctcactctttttagtggtgccctagccgctgacctgtctgaatttcctggacaaaaactaggtcgtgttttgctacagtacattgatgacctcttgctagctagcaccacacaggctcagtgcctaaagggaacaagagctctcctttccctactaatggaggcagggtattgggtatcaaagaaagaggcaaatctgtaaaaagcaagtcaagtatatgggctttaacatcatgcagggctgacaaatgctggggacaaagaaaacaggcagtttgtgccatttctgtccctaccacctgccagaaatttcatgagttactaggggcagcaggatgctgccggatatggatccccgggttttcagatttggccaggtctctgtatgaggctctaaaaggggaagaaaaactccccttgaatggggaccaagccagaaggcagcatttcagacaatcaaaaccaaacttactgaggttccagccttaggacttcctgatataaccagagaatttaacctttttgttcatgaaaaaaatgggatggctttgggagtcccaaaccaagagttctggccttggaagaggccagtggaatatctgtctaaacaaattgacttagttgtggctggatggcctccctgcctctgagcagtggcagctaccaccttgttggtgagagatgctgacaagttgactctgggacaaaacctcaatgttaaagtcctgcactcagctgtaaccctaatggatactagaggccaccacttgctcatgcatgcatgaatgactcagtatcaagggttactatgtgaaaatccatgggtaaaactggaggttgtacaaactctgaccccagccacttttctgccagatgaagcagggcccccagaccataactgcttagaggtactagatgaagtgttttccagcaggcttgacttgactgataaaccactccaaaatcctgacctggttttatatactgatggcagcagctttatagaagatggaaaaagaatggcaggtatgctgtgttatctgacttaaaagtgatagaagcagaggtgcttcctcaaagctgatcagcactgagagcaaaattatgggccttaatcagagtgttggagctcagctgagaccagtgagttaatatctatactgactcagctttgtctttgcaactttacatgtccatggagccttatataaggaaagagaactcctaactgctgaaggaaaagtgattaaaaaccaggctgaaatctttttttttttttttttttgtctttttgccttttctagggccacacctgcagcatattgaggtccccaggctatgggtctaatcagagctgtagccacaggtctatgccagagccacagtaacatgggatctgagccatgtctgcaacctacaccacagctcatggcaatgccagatctttaacctgctaagcatggccagggatcgaacctgcaacctcatggttcctagtgggattcattaaccgctgagccatgatgggaactccccaaaactttttaaggctgaaatcttaaaactcctagaggaagtatgggagtctaaagaagttgcagtcatccactttaaaggccaccaaaagggaggtgacccagtagcaaaaggaaaccatagcactgatacagctgccagacaagcagcccagggacaacatccagacaaacctaagatcttgctggccatgaaagtgtcagctgcccctgaatattctccagagggagaaaaatgggtaagggaggaaggaggaaccaaaactaagatgggatggtgggtcatacaggaccaccaggtttgtgttctgaatagctagcctacaaactagtctaccaacaacacaagttaacccacatgggcaaaactgccttagagaccttactgggctggtactatctcattgcacatcttctggccctcttctcttcagtctgccaatggtgcataacctgtttgcaaaataatgcttgccaggggcctggcagaccaactgggacacagcactgtggactgtccccatttgaggatatgtaagtggactttactgaagtcaccccaagcaaagcatacaaatacctactagtttttatctgcactttttcagaatgggtagaagccttccctaccagaaccgaaaaggcaagggaagtaaccaaggcaatcctgagagacattgttcccagatacagaatgcctttgaccattgggtcagacattggactggcatttgtggctgagacagtgcaacaggtggcaaaagccttacagatccaatggaaattacattcttcttattgacctcaaagttcagggaaagtagaatgcatgaactggacccttagacactggcaaaataatgtcaggaaactggcttgccctgggtagccatgatgctggtggctctcctaaaaatgaaatgctcaccctgagtgggaataggcctcctatgggaggccacctctgctaatcaatctaagaggaaacaccagggagttgggagacttggaattacataaacaattacaaggaatggggctcactatctctcacatatatagatgggtcacagatagaatacctgagtccggagttcccatcgtggcgcagtggttaacgaatccgactaggaaccatgaggttgagggttcggtccctgcccctgctcagtgggttaacgatccggcgttgccgtgagctgtggtgtaggttgcagacgcggctcggatccagcgttgctgtggctctggtgtaggctggtggctgcagctccgattcagcccctagcctgggaacctccatatgccgcgggagcggcccaagaaataacaaaaaaaaaaagaatacctgagtccttaggcataacattatacctcacaagccagggatccaggtgtggataaaggactggaaaaaaaatgagcctttgaggctggtatggaagggcccctatactgtaattctaaccactcccactgctttaaaagtaacaggaatagacgcttggatccatcattccagagttaaactggctggcccagctaaaaactgttgagagtgggcgactgcctttgatctggagagacccctatgcctgacaatacagaagaggagacaatgatctcaaagctcttctctgaccatactggacactggccagtcaacacatggctgaagcttgaggaatctgctgcctggtaaaataaactaccttatcttctgcaagagaatttcttactgttaaatactgttctcttatatccaacatgtatgtttgctgcctgttgctgtaaatatgggccccccttggccctgccaggatcaatttccttatgtgatccatgcattcaagtgacccaatcagatcaaggggttacatggactttgctttactccactcatttctcctgttcaggagaaattcaaggaagttgtactcacaacaggaccacttattctatctgtcagcagggggaaaaatatacttgctttgatccacaatactcaccagctgaggaatggttagaggtctggtgctctcataaatcagggcaactaattaatcggatccaacttaccaatcccaagttgccagtatctatacattttgatgcctgtgaagctatgaatgggtcatggacttataccagaccatgaggaagcccattattggaaagagaatataggctccaggataaatatatgtgctgggggaccacctggagtggttgccaggaatgcatttactggagttgtgtaacctgggcaacctgggacaagggagacagaacagctgtccttcaaaagagtacagcccctcagactgtcagactaaaacttgtatcccagttaatttcactatttacaatcccagtgagcccaaatggaaggagggtttcaaaataaacattcacattaatggaagtggccttgaccctggagctctgttatatttccagagagtcacatttatgctccaagctgcctctcacagggtctttcattccttttatgaagacataaagaacactccacctcccattctggccacaactaagaacttgtttttggccctggcagaaactattgcacaaactctcaaggtctccccttgttatgtatgtgggggaacaaatacaggagaccactggccttggcaagccagggaactgaacccattatagcctcattatgagactgcatacctacaacttgctggtggggtatggctcctcaaaactgctattatatggagaaactgtcttgtgaggtggggaggatggttcaatgtctcagttggaagcctaacatatttaggcctaaggttttataaaatgactgcccaaaagactcattggtgggcatcctctaatctctcagaacccaagcctaatcctctgtctgacttttcctacctccaacaggcatgggatgatataagtgctgatatccaatggcaggcaccaaagggattatattggatttgtggaaaaatggcatattccaaactcccccccaattgggctggggcatgcatactgggaacaatcagaccatccttcttcctgctcccactgtcactaggggagcaactgggctttcctatatatagggaagagggcacccaaagagactggagggctctccagattggagactggaaagatgataaaagacacccagaatggataattcaatataatgggcctgacacctgggcagaagatggctcttggggatatttcacctctatctatatgctgaactacatcattgtactagaggtggttttggaacttataacaaatgacactgcaagggtccttactatattagcccaacatcaaaataaaatgtgaaatgacatctacccaaacttctgggccttggattatttactttcttctgaaggaggggtttgtgaaaagtttaacttgagtaattattgtctacaaatagatgatactggaaaagtgatagaagaaattgctgactgcttgactaaaattgcccatgtgcctgtacaaacttggaacagatgggacatggacagtctttttggtggatggttcttttggttggggggaattaagacaatggtcagaataatcatggtcatacttgcggggtgcctgcttattccctgccttatacctttcctgataaatattataaaaggttttataaaacccatggttgaaagaaaaacagcctcgcacctgctacttatcagagattaccagcaggtaatggctgatgatgacctctgatgggtgcagatgcaccctgaacatcaagaggggggaatgaaagaagagttttaactaaggaacaacctccccagctaaaaaagcagctgtaagtcttttcagctatgctcacctcataccatccttcttgtaataatatagcaactctgtaccctatgtccaagccagcagccctgctaatggtgttcctagcattgcttatcagttctgcttctgtaaccttgcttgctcagtttcttagggagaaactctgctcagggaagcagggagaacttggggatacttacatgggaaaaacaagaccctgtaatgtataaaaatcgccaagaaca

SEQ ID NO: 138 - DNA, 3599 bp, Artificial
  ss1176 sequence
ccttcaatcagttttacaatctgctagtgtagaggatcagaactttttagcatgccctataaatatcaccccagatcctcaagtaccaggacaaaatatccatatgcataacacttttgattttaaagctcttaagtttcttcaggatagtgtaatacagaatggagttacagctccctttactatgagtatggtagaaagcatggggacacttcatctgcccccatgggattggcatatgatagccaaagccatcctagatggtagagactatttaacttggaagtctagtctttcagatttttgtcaggaacagactcacttaaatcaaaaaaataatgttccaattacttttgaaatgttggttggcatgggtccttttcttgacttagcaaaccaactgacttatgatcttcaggtgtatgagcagttgagtctggaggctcaaagagcatggataacattttctgagagaggaaatccacaaggatcttttgtacaatgccttcaagaccctatagaacattacccacaatttgtgaacctcctaacttgagtggtacgtcaccaagtatcactttctcaggtggctgatattttaaataaacaattggcatatgaaaacacaaataaagattatttaattttaaaaagattattttatttaaaagggcaatggtccctataaaaaattcagggggcatctctgattttattaaggtgcgtcaagatgtagggagtacaagtcatactcaagcaatgcttgctgcagcattgaaaggaacacttggaagttcaggaaagaaatgttttaactgtggtaaggcaggacactttcagagagaatgctgagcccactgaaaagaaaaggcacaccctgcaacaagatcatctccaggacctagtcataaccctagtttatgtcctcattctcagaaagagaatcattaagctaataaatgttgatttaaatttcaccaaaatggcaccccacttacagctttagtgtcaggaagtggaatttgggtcctgccccagccctgtcaaccaataagtgcatttgtggctcaaactgaaaaggaatccaatctcttacaagggccacacctagcagcactgggttggactttgtgccacagcaacagttttgatgtgtgaacagggcattcaggctatctctactggaatttatggccctcttcctcctgacactgtaggcctcattatagtgagaagtggcttaaccatgaaaggcttacaagttttgcatggggtaatagatgcagactatcatggagaaattaaggtgatagcaaggtcagatgccattcatactatacagccaggaaagagaattgctcaattgttactgttgccatatcttaagataggaaagagttgccagaaagaaaggggaacatcaggatttggaagttcagtgacttctcaagtcttttggactcaggatgtcactactgaatgtccacaaatgactgttaaggttaatggaaaaaatataaggggattagcagatactggagctgatgttttgtttgttatagtgattggcttcccacatggcatttaattaccccctccccaaccaaagttgataggattaggagttgggactgcagtccatcaaagttagcagatgctttcctgagttggaccagaaggaaaaatgggttattttaaaccttacattgctgatatacctgtccctttttgggaagagatcatctatctgctatgagacttaaattaacaactgagaatgtctgttgtgattctaatgattcttcccccgatggaaactaatggaaaaacttaggatatacaaaacaaacaggcttaggaaaaaacaatgaagacataaaagaacctataaacttgcccattaagtttgataaacatagaatagggtttgatgagtatttttaataggagccattgaaaattggcccatgcaggtcctatatgatggattaatgatgatctaatttgggtagataaatagaccctaactcagaaaaaattgactaaaatacataagctaatagctcagcaattacaaccaggatatattgaggaaactaaaagcccatggaataccctatttttactattcctaaaaaatcaggtaagttgaggctattacctgatttaagagaaattaataaaacaatgtatgctatgggagacttgcaaccaggcttgccttctcctactgcaattcccttagactgggccttaattgttatagatttaaaagactgttttttcaccatacaattagcccctcaagataaatgtagatttgcttcctctgttcctgctttaaataacaaagcacctataaaatgatatcaatggaaaacattgccacagggaatgaaaaacagacctaccatgtgccaaaaatttgtgaataaaccttagctcctgttagacttaaatatcccgaggcatatattatccattgtgtggatgatagtctcctttctgcctcaaatgaacaagtttttaacatctttctggatactgagatatatcttaaagggggcttattatagccccagataaaataaaaaaccctccatttcaatatttaggaacttcgatagaaggtcatactattcagccacaaaaaaaaaaaaatgcaaatttgcaaagaccaattgaatacattaagtgattttcaaaaattattgggagatattaattggctacagtcttattaaggaattactacaaattgattaactcattttttaaaacattgaaaggcaatcctgaccttacctccccacatacattttctcctgcagccctcaaagaattacagctggttgaagaaaaaataaatgagacacatttgcaacatattgattatgataatcctattattctgatctgttgccttctataaattcacctacagcagtcctagttcaggaaatgccacagtttggcattgtcaaatggatctgtctttctaatcaagaagtaaaaatggcaacactttatgtggacctcatagctaagattattatccaaggcagatgctgtcttgaacaattgaatggagaggatctgatagggatggagtaggcacaggtagttttagaagtgccaataaaggacagttaaagaaggaaattaggggacattgggagatcaccgtaagttaataacttctcaagaaaccatcagcacaaggcaggcttgcttgactagtggaggtatgtgaagtggtcattaataccagaattctctgaaagctcatctgttaaggcggttaatccacttagggccttggtgatggtgctgtcttgtgtggtgttgttgggaatgaacagcactgaatatcagtcattacatggactccacccttttctgtaagcatcatgtctaaagcaagtctattttaccttgccatttgactagtttgccctagctgttcagctatttttttaatgacatctctagtgtaattaatgaatctttgttgattgtaaaatatgcagtttatccaatcaacatttttgtttatggttgaccaccaaaagaaagcagattcaaacccagcagctacc

SEQ ID NO: 139 - DNA, 3901 bp, Artificial
  ss1180 sequence
  misc_feature (2856)..(2955): n is a, c, g, or t
caaaagatcctacaaggtcctaaggaaccttatactgaatttttagctcatttataagagggttaaaacaacaaattactaattttgaggtgtctgatactattcttcaattattagcatatgaaaatgtgaatactgattgtaaaaaggccataggatttttaaagggaaaggctaacattgctgaatatattaaaacctgtcagggagtagggatggagtcctttaaggcctcaatgctagctcaagcaatggctaatttaaaagtaaaagacaaatttttagaaaaatgttttaattggagttcccgtcgtggtgcagtggttaacgaatccgactaggaaccatgaggttgcgggttcgatccctgcccctgctcagtgggttaacgatccatcgttgccgtgagctgtggtgtaggttgcagacgcggctcggatcccgcgttgctgtggatctggcgtaggccagtggctacagctccgattagacccctagcctgggaacttccatatgccatggaagtggcccccaaaaatagcaaaaagacaaaaaaagaaaaatgttttaattgtggcatactaaaaaacaatgtcatgctcctccacgagcccaaccttcctttcacggatataataaaggatatcactgggctagtcagtgctggtccatctttcataaagatggaacccccttgtcgggaaattctccttcaggcaagcttccagccccatccaccaaggaagctttccctattcagaacaaaagccaaactctcaactgaagtgagattcccagagactacattctgtacaagcatttaacatcacagtagatcttcttagtttataggatttaattctacttcccagtgaaactcctatttttattacaaccaaattagaaaaaccattaccaactgacatggtaggattgataataggaagggcagagctaatggaacaaggagtttgagttcataccagtatattggataatacagaggatgataaagtacaggtgatggtttccactgcaatgccttggaaggttaaaaaagggaattgtattgctgaaatcttaattttacctagagtacagaagaaaaaagataggaataattttagaagggatttaataccacaagaggggcaggagtgttcttatctgaaaaggtcctagaggaatgacccacttgtgaagttatcataaatgggaaatcttttagaggactaattgatattggggctgatgtttcaatcattagccatttacattgcccagacacctgtcctcttcagccagctgatattgaagtcactgggttaggaaaagcagagggtctcaaaaggagtgcccaatggcttaattgtgaaggactggatgggcagctagctaaatttaaaccttatgtagctcaactccctattaatctatgggggagagatttattacgacaatagcgtgcaaaaatttacttgccaccagtagatcaatatagtcatcaaagccaaaaaatgttacagaaacagggctacaaacctgttgaatctgagattaaagtggaaaaatctggtgtgggacattggccttttcattaatggcaactgcttgtaaaaaccattatacttctcctgaacctattcgattaaaatggactacagaaaaaccagtttgggttgagtagtggcctctttcttcagaaaaattaaaagttttaaacaatcttgtccaagaacaattggagaagggccatatagaagaatcctttagtccttggaatcaccagtgtttgttatacagaaaaaaacagatggagattgttaacagatttaagaagagtaaatgctgtaattcagcctatgggtgcccttcaaccaggctttccattgtctagtatgataccagcagactggctgttaatcatactggatttaaaagacttttttcacaattcatttacacccagaagatagggaaaaatttgccttttcagtcccagtgataaacaatatagcccctagaaaacaatttcaatggaaggtcctgcctcaaggtatgttaaacagcccgaccttgtgtcagtattatgtggcttcagttattgagccagttcaacaacaatttcctaaatgataatattattcattatatagatgatatactttgtgcttcaccctcttgggagcagctgattgaggttttcaatgcttgcaatcctgtctaaaaaggagcaggattgattatttctaccaaaaagattcaaatgaaaagtccatatcaatatatgggaagtgtggtggaacataccactgttcaccctcaaaaggtagaattaagaagagatcaaatttctacattaaatgatttacaaaaactgttaggagatattgattggctctgacatatttggggattcctacatatgaattgtcaaatctattctccttacttaggggagattctaagttacacagcccccgctctctaactgcagaagtggaacaggaacttaaaaagattgaaagtaaaatacaaaattcccaactaagctgggtcaatttaaaacaacccattcagttagaaattatactgtctcctcattctcccatgggaatattgatgcaattagaaaatattctcgaatggctttttcttcccaataatgtcacgaagtcttcgtctccatacctggacttgatggcacaacttattctaaaaggtcatactcattctgtacaaatgtccggaaaagatttgaatcatgtgattgttagtttaactgttaaggaaatccaaaattgttttcaaaaccatataggttggcaaattgcttttgcagattatgtaggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattatgcgtagattggcccgttttatattatcccataggtctcttatattgctttccagttttttgattcggttttcggtctgttgaccagattgagtgatttccattattctatcttccatatcactgattcgttcttctgcattattcattctggtttttactgcccctagttcagtttgcatctctgcaaatgaatgttctagtttttcttggctcctccttatattttctagctcctttctgagggtgtctgcattactgttcatatcttctcttaattccttcagtattttcagtatttctcttttgaattccaggtctgtctgactgcagagatctgtttcattgttgactgttttaggtgagttcttctgttggtttgactgggggtggtttctcagcttcttcatcttgcttgttgtcttctttctcctgagggagttgtactctccgttatcgggtagtgtttgccttgtcactgccgtgaaatatttcctgagggctgtcgttgttggtcaatcttttttgaggcagtgtggcttttctggagtgttgatgggactaacagtgtttctttgaagcagaggaggacttcctgagggcagacaggactgggaggtccaccccacgatggtagcagatttcacttggttctcagcaccccctggggtcttgggcgggtagcagggcccttggagactcaagaggctcttccccagggcagcccgattcagaaagaccgtctgagatcttttcctgattcggccaggcttgttgcagcttttctgggctgcaggggggtcctgcctggagctggcagtcctatgcagctggtccactaggtctcagcattccctgggggcttgggcgggtagcagggcacttggagactcaagaggcacctccccagggcagcccgattcagaaagactgtctgagctc

SEQ ID NO: 140 - DNA, 8159 bp, Artificial
  ss1182 sequence
ttccttaatcccactaatctcattaccttccttaataaaagtcatgtgggttaaagccttgcaccttttgttccgtggaacagaatgtctcctggccccccactttctaaaagtaaaagagtcttgtgtgttttgttataccataccatccctctttcaggatcccccattgccgggcagctcaggatgcagcaaagtggcacccaatgtggggctggaagagaaggtctgctaagaagagaatatgaaactatagatggaggagatgataaccttgcaaattgatggagtcctgaccatgagtgagcaagtagaaaatttaaaccaggataccaatggggtggaatcaatcaaaggaaagtaaacattgtattcaattgcttaaatgtatgttgaaacagtcaggtgttcaagtaacagagtctaagatagaggaattgtcagaagccatgatcaaacataacccttggcttccaggctagggtattgtggacctgaaatgttgagatctcatgggagaaaatttaaagcatgccaatcagtctggggcctctcttcctgtttctgttttttccaaatgggcactagtaagacattttgtggaactcttgtgggagcataaagaaaagcctgtgccttcttccttttttttttttttttgtcttttgtccttttagggctgcaccagcaacatatggatgttcccaggctaagggtctagtcagagctatagctgccagcctatgccagagccatagcaacaccagatctagccgtgtctgtgtgacctacaccacagctcatggaaaagccaggtccttgacccagtgagtgaggctggggatcgaaactgcaattcatggttcctagttggatttgtttctgctgtgccatgatgggaaccctgaaaagcctataccttctgctccccctcagactgatccatttcttgagagtttaagactttagctgtggaggcaacactaactccccttcaatcagttttacaatctgctagtgtagaggatcagaactttttagcatgccctataaatatcaccccagatcctcaagtaccaggacaaaatatccatatgcataacacttttgattttaaagctcttaagtttcttcaggatagtgtaatacagaatggagttacagctccctttactatgagtatggtagaaagcatggggacacttcatctgcccccatgggattggcatatgatagccaaagccatcctagatggtagagactatttaacttggaagtctagtctttcagatttttgtcaggaacagactcacttaaatcaaaaaaataatgttccaattacttttgaaatgttggttggcatgggtccttttcttgacttagcaaaccaactgacttatgatcttcaggtgtatgagcagttgagtctggaggctcaaagagcatggataacattttctgagagaggaaatccacaaggatcttttgtacaatgccttcaagaccctatagaacattacccacaatttgtgaacctcctaacttgagtggtacgtcaccaagtatcactttctcaggtggctgatattttaaataaacaattggcatatgaaaacacaaataaagattatttaattttaaaaagattattttatttaaaagggcaatggtccctataaaaaattcagggggcatctctgattttattaaggtgcgtcaagatgtagggagtacaagtcatactcaagcaatgcttgctgcagcattgaaaggaacacttggaagttcaggaaagaaatgttttaactgtggtaaggcaggacactttcagagagaatgctgagcccactgaaaagaaaaggcacaccctgcaacaagatcatctccaggacctagtcataaccctagtttatgtcctcattctcagaaagagaatcattaagctaataaatgttgatttaaatttcaccaaaatggcaccccacttacagctttagtgtcaggaagtggaatttgggtcctgccccagccctgtcaaccaataagtgcatttgtggctcaaactgaaaaggaatccaatctcttacaagggccacacctagcagcactgggttggactttgtgccacagcaacagttttgatgtgtgaacagggcattcaggctatctctactggaatttatggccctcttcctcctgacactgtaggcctcattatagtgagaagtggcttaaccatgaaaggcttacaagttttgcatggggtaatagatgcagactatcatggagaaattaaggtgatagcaaggtcagatgccattcatactatacagccaggaaagagaattgctcaattgttactgttgccatatcttaagataggaaagagttgccagaaagaaaggggaacatcaggatttggaagttcagtgacttctcaagtcttttggactcaggatgtcactactgaatgtccacaaatgactgttaaggttaatggaaaaaatataaggggattagcagatactggagctgatgttttgtttgttatagtgattggcttcccacatggcatttaattaccccctccccaaccaaagttgataggattaggagttgggactgcagtccatcaaagttagcagatgctttcctgagttggaccagaaggaaaaatgggttattttaaaccttacattgctgatatacctgtccctttttgggaagagatcatctatctgctatgagacttaaattaacaactgagaatgtctgttgtgattctaatgattcttcccccgatggaaactaatggaaaaacttaggatatacaaaacaaacaggcttaggaaaaaacaatgaagacataaaagaacctataaacttgcccattaagtttgataaacatagaatagggtttgatgagtatttttaataggagccattgaaaattggcccatgcaggtcctatatgatggattaatgatgatctaatttgggtagataaatagaccctaactcagaaaaaattgactaaaatacataagctaatagctcagcaattacaaccaggatatattgaggaaactaaaagcccatggaataccctatttttactattcctaaaaaatcaggtaagttgaggctattacctgatttaagagaaattaataaaacaatgtatgctatgggagacttgcaaccaggcttgccttctcctactgcaattcccttagactgggccttaattgttatagatttaaaagactgttttttcaccatacaattagcccctcaagataaatgtagatttgcttcctctgttcctgctttaaataacaaagcacctataaaatgatatcaatggaaaacattgccacagggaatgaaaaacagacctaccatgtgccaaaaatttgtgaataaaccttagctcctgttagacttaaatatcccgaggcatatattatccattgtgtggatgatagtctcctttctgcctcaaatgaacaagtttttaacatctttctggatactgagatatatcttaaagggggcttattatagccccagataaaataaaaaaccctccatttcaatatttaggaacttcgatagaaggtcatactattcagccacaaaaaaaaaaaaatgcaaatttgcaaagaccaattgaatacattaagtgattttcaaaaattattgggagatattaattggctacagtcttattaaggaattactacaaattgattaactcattttttaaaacattgaaaggcaatcctgaccttacctccccacatacattttctcctgcagccctcaaagaattacagctggttgaagaaaaaataaatgagacacatttgcaacatattgattatgataatcctattattctgatctgttgccttctataaattcacctacagcagtcctagttcaggaaatgccacagtttggcattgtcaaatggatctgtctttctaatcaagaagtaaaaatggcaacactttatgtggacctcatagctaagattattatccaaggcagatgctgtcttgaacaattgaatggagaggatctgatagggatggagtaggcacaggtagttttagaagtgccaataaaggacagttaaagaaggaaattaggggacattgggagatcaccgtaagttaataacttctcaagaaaccatcagcacaaggcaggcttgcttgactagtggaggtatgtgaagtggtcattaataccagaattctctgaaagctcatctgttaaggcggttaatccacttagggccttggtgatggtgctgtcttgtgtggtgttgttgggaatgaacagcactgaatatcagtcattacatggactccacccttttctgtaagcatcatgtctaaagcaagtctattttaccttgccatttgactagtttgccctagctgttcagctatttttttaatgacatctctagtgtaattaatgaatctttgttgattgtaaaatatgcagtttatccaatcaacatttttgtttatggttgaccaccaaaagaaagcagattcaaacccagcagctacctgatttcttgtcttaaatgtgtttggaacacctattgagtcaatatagacctgggggtcaaaggaccaccaccctccatgggagtgacgtctcattttctcaggattggctgagtttgagattggggcctaaatgccagggtgaaagggatggccaattgtaccaaagtacaggtgtcactctgatattctggaaggatgcccattaatggactcccacaataccaccagacatctgcctggggcattttgaactgggatttattgtgggggtgatgtaggaccagctttcactgctcctggtcaggttgcctaagaaagtcacctttgcctcttgtcattttagacataaggagaagttgacattttcatttagctgcagaacagttctcaggggctgacccacagaattttgacctcagggaatagcagtgacaaagtccaactggactcattatttcaagccattttgtccttgaagatgactatcacacattcaaaaccctgtgggtctgataaccatcccagaggaaagggaaccacttgggcctccggtctccctatggcacaagcataacagctgcctttgtgtaatgtgtccacagaatattttatccattttaactgggcgtttgtgcccccatatcctgtttttatactcacagtcagccttcctccaaaggtaagttttatgttttctttagtaaatagggcagtggtggctaccaactgtatgtactcagccatcctctggaaacagggtccaggaggcaggaaaggaaggctgccagctggtggcttttcccatgtttctgcgtaaggacccctagagctatcccctggcctatgtttacaaataaatgaaaaggattttcaaaaggatgttagaaccagaagaggggcaactgtcagtgcctctcttaaatccctaaatttttgtacctcctcctggctccacaataagttatcagggtcttcctctacaagcttggaaatagtccttatatattatgtctttttagtatatatagtccccttgttgcaggttttagggcatctgatttttattgaaaaataaattactgagataaactttagaaagaagcttagaatgttcttttagaagctcagttaaactttgcagcaatataatataatagcaaagaactatctaggaagtaagtcttagtgatactgaccacaattaaaagaatgagattaacagatttagcaagttttcattgaaacatctctttctctctaaaattactcttatttttatcaaatattagccaaaccaggactaatttatttgccaattaagtctgatatcaacaaccttggcctgatgattacatgaataaaattgatcatatagatttttttaattggttttattagaacttcatgaggaatcttagactaagcttttaaaaggcacctcagggctaggaatgtcatgccaagggtttgtcttaaagatttttatcttaaagatcttggtgaattccttcccttttagaaacccagataccttgatgtttttacaggctctgtatatggtagccttcctaatcatctgataaagcttctgggaacctgagagtttccattctctgaagaaatcaggtagagaagagagaaatatttctgttctcctttcaaagatataatttaccaaatttcttattggggagaatttctttatacctggaaaacacagattaaaagccagtattttttaaatagaaaccataaaattataaccatatttaccagttcacatagtccaacataaccaatcttttttgtttaactgtttatgaaatcatcaattatcctttcagatttttttttaatttcttagctcatcattaaggtatggaagtcagaaatttgtatttcttaaaaaaaagtttttttctgtagatcttctagaaaaagaaacatttttgcaaaggtatcagagtaaagccattaaccaacagtgacaaaagatttaaggcacattttatatctgattgcaatgcaaattgacaatgaaactttgtaactgctgtgacataacaatttgaaataactagagaaaaaaaaggattataacatagtaccagtatatatccaaatttcagaaactgtaaaagttctagaatatctatattaaaaacagctatttatttatataacctgaggtttatcactcatttaacaatactctctatgtattttaacattctaaataattctagtaaatttaactttttttaaaaatgcctcaaggatcccatgaagcattttaaagttagctgagttagctgagttaaaagcactttaattggaatttgatggtgtttataaacaaaactttttttttaaatttggtcagataaaatcataagtcactgtggataatatttctttcttaaccaaagttactagagctctcaaaagcaaatacagcacatcacttaaaagaaacattatattatctattatcaaagtagcattccaaggaaacttcattttcttaacaaagaaaagccaagttcaagttttgtaccaacttattttaaaattaatttactcaaacttattttaaactgagttctgacaatgtataacacttctctcaatttctacttcccacaaaacttccagcactttctgtatccattagtttgtcctccattttccatttaaaacaagctagaagacagactaactcttcttttcccttgataaaatagaattccattcctcattatttctcacatataccttttatgtctctcttagtaatttctcgaatagtttatctttccaatccattattttatatatatatatatatatatgtttatttatttgtacttattattttgtcttttgagggccacatccacagcacatggaggttcccaggccaggggtccaatcggagttgcagcaactgacctacctcacagccacagcaacaagggatctgagccacatctgcaacctacaccacagattccaacaacactggatccttaacccactaagcgaggccagggaccgaacccacaaccccatggttcccagtcggattcactttcactttgccatgacaggaactcctgacattgttttaatgctcacctaagtctggaataagaccctgccatatcctttggctttgttgagaaggtgggctttgatcccatgggtggggcagcacacttttgcctgtggcctaaccctcctgttctgactctgtaagcagcagcagtgtgcttgtgcatgcatggggctctgcacccctcccctcctgtattaactctgtgagcagtggcagtgcccttgtacctgggtggtgggctttgcatgcctccccttcctatgctcccccagcagtgacagcggtggtggctgtggctagaggggggccagtgccattttgcagattggaaggtggcagcagcaagccaagggggtcctatggaggagaggaagtcccagaatgttcttgggtttcctcctcatttcccttttggtcccgtgctctggagggaaataagaagaccactg

SEQ ID NO: 141 - DNA, 9854 bp, Artificial
  ss1181 sequence
tgattgttgagagaaatgtttctctaattttccttgattatcctccaatagcccctcctcacgtgatctcatttaagaaacgcaataaaagtggtgtggtttctggaagtggggctcttggtccctgagatcttgagtccccagggttctcgcctttactatctctctctctgtcttgttatttttgtgtcttgttgttttgttattttttccttaagttccatagcacccgtttttcatccccatcctgctgagctggcttctgcaagtggtgcccaatgtggggtgggcaaacacaaaggcacaaggaatgaaaggccgcgactacagtgatattttgtggaagtgctatggagccctgagaagaagggaggaattttgcgtggccacactaaaaaaaaaaaaaatcctatggataagttcctctctcaggtatttacagggttaaatgggaaataaggtaattgcaggaaaccataattcttatatttgtttgttaagacaactccttaaaaaaagggggcataaaaataagtgaaaataagctctcagaactttttaagactattgagaagcactgtgattggtttcttaccttagaaatgtttaaaaatatgggaaaacataggaacagagcttaggacattgcatgataagggcgtttcaattcctgtgtctctttggaatacttggagcttaatcaaatcagttttagaacctctacagacttcatggaagttagaggaggaagaagaaggggagtttgtgcctttgttggaggaatctaaatatgtagtccctgaacaaaattatcatagagaatatttggctcctgagtcttcagctccaattgttgatcctgatattcctcaattgcctcctattaggagtaaggcgatgaggactcatcaagcctctacttctaggcttgcaaaggaaatgagtgttatccctgaatgccatctatcatctatgcaacagggaattttacaggctctaagggaaggtgatttggatgccatacgtttagcctttccattgtcagggagacaatggcttcaggcattgatcttgccaatcctaatggagtttatgagttcattcatgagccctttcattttaaaattcttaaagaattaaaacaggctgttcaaaattatggtgttaaactctccctttacaaaaggaatcatgcagggagtagctgaaggaaattgttatgattcctgctgatttggcatagcttaacctgtattgtgctatcacctagtgaatacttgcaatttgaatctttgtggcaggatcatgcccaaattgctgctaattgtggtcaggctcaaagttttcaaagttttccgattacaatggaaaaattgttagggattggttcttggagtaatcttcaggatcaaatgaggatgaatgatttggccattgaacaaatcaaacaatgttgcttaatagcatggggtaaaattgaatctaagggccaaataaatacttcttttcaaaagatcctacaaggtcctaaggaaccttatactgaatttttagctcatttataagagggttaaaacaacaaattactaattttgaggtgtctgatactattcttcaattattagcatatgaaaatgtgaatactgattgtaaaaaggccataggatttttaaagggaaaggctaacattgctgaatatattaaaacctgtcagggagtagggatggagtcctttaaggcctcaatgctagctcaagcaatggctaatttaaaagtaaaagacaaatttttagaaaaatgttttaattggagttcccgtcgtggtgcagtggttaacgaatccgactaggaaccatgaggttgcgggttcgatccctgcccctgctcagtgggttaacgatccatcgttgccgtgagctgtggtgtaggttgcagacgcggctcggatcccgcgttgctgtggatctggcgtaggccagtggctacagctccgattagacccctagcctgggaacttccatatgccatggaagtggcccccaaaaatagcaaaaagacaaaaaaagaaaaatgttttaattgtggcatactaaaaaacaatgtcatgctcctccacgagcccaaccttcctttcacggatataataaaggatatcactgggctagtcagtgctggtccatctttcataaagatggaacccccttgtcgggaaattctccttcaggcaagcttccagccccatccaccaaggaagctttccctattcagaacaaaagccaaactctcaactgaagtgagattcccagagactacattctgtacaagcatttaacatcacagtagatcttcttagtttataggatttaattctacttcccagtgaaactcctatttttattacaaccaaattagaaaaaccattaccaactgacatggtaggattgataataggaagggcagagctaatggaacaaggagtttgagttcataccagtatattggataatacagaggatgataaagtacaggtgatggtttccactgcaatgccttggaaggttaaaaaagggaattgtattgctgaaatcttaattttacctagagtacagaagaaaaaagataggaataattttagaagggatttaataccacaagaggggcaggagtgttcttatctgaaaaggtcctagaggaatgacccacttgtgaagttatcataaatgggaaatcttttagaggactaattgatattggggctgatgtttcaatcattagccatttacattgcccagacacctgtcctcttcagccagctgatattgaagtcactgggttaggaaaagcagagggtctcaaaaggagtgcccaatggcttaattgtgaaggactggatgggcagctagctaaatttaaaccttatgtagctcaactccctattaatctatgggggagagatttattacgacaatagcgtgcaaaaatttacttgccaccagtagatcaatatagtcatcaaagccaaaaaatgttacagaaacagggctacaaacctgttgaatctgagattaaagtggaaaaatctggtgtgggacattggccttttcattaatggcaactgcttgtaaaaaccattatacttctcctgaacctattcgattaaaatggactacagaaaaaccagtttgggttgagtagtggcctctttcttcagaaaaattaaaagttttaaacaatcttgtccaagaacaattggagaagggccatatagaagaatcctttagtccttggaatcaccagtgtttgttatacagaaaaaaacagatggagattgttaacagatttaagaagagtaaatgctgtaattcagcctatgggtgcccttcaaccaggctttccattgtctagtatgataccagcagactggctgttaatcatactggatttaaaagacttttttcacaattcatttacacccagaagatagggaaaaatttgccttttcagtcccagtgataaacaatatagcccctagaaaacaatttcaatggaaggtcctgcctcaaggtatgttaaacagcccgaccttgtgtcagtattatgtggcttcagttattgagccagttcaacaacaatttcctaaatgataatattattcattatatagatgatatactttgtgcttcaccctcttgggagcagctgattgaggttttcaatgcttgcaatcctgtctaaaaaggagcaggattgattatttctaccaaaaagattcaaatgaaaagtccatatcaatatatgggaagtgtggtggaacataccactgttcaccctcaaaaggtagaattaagaagagatcaaatttctacattaaatgatttacaaaaactgttaggagatattgattggctctgacatatttggggattcctacatatgaattgtcaaatctattctccttacttaggggagattctaagttacacagcccccgctctctaactgcagaagtggaacaggaacttaaaaagattgaaagtaaaatacaaaattcccaactaagctgggtcaatttaaaacaacccattcagttagaaattatactgtctcctcattctcccatgggaatattgatgcaattagaaaatattctcgaatggctttttcttcccaataatgtcacgaagtcttcgtctccatacctggacttgatggcacaacttattctaaaaggtcatactcattctgtacaaatgtccggaaaagatttgaatcatgtgattgttagtttaactgttaaggaaatccaaaattgttttcaaaaccatataggttggcaaattgcttttgcagattatgtaggatcaatagataatcattatccaaaaaaccctattttacaatttataaagtgaactcaatggattcttccaaaaaaagtgaaggatttacccatcattgaagcacctgtgatctttactgatgggactagtaaagggaaggccggatatgtggctaatcaatctaaaattatagaaatgcttggcctttctgctcaacaggctgaattaactgctgtaatccatgccttgagggactatcctgagccaatcaatattctttctgactcagcatatgtagttcatgcttccaaaatgattagatctatttacaagattacaaactgttgtaagggaaagaagatattcattttatatcactcatatcagagcacacactaacttaccgggacttctagttgaaggtaataaagaaattgattgcttggtaacacctgtgttacaaaagcttaacattttcatgatttaacacatgtaaatattcaaagtcttaaagagagatttggaataacatgggctaaagctaagacaatagtccgtcaatgtcctgcatgtcaaactattaaaaatccttctcaatctgagcctggagttaatcctaggggacttgtcccaaatgctctttggcaaatggatgttactcattattaatcttttgggaaattatcctttattcatgtatgtattgacatttgctctaaatttatttgggctactgctcaatctggtaaatctgctaaacacattattcgtcatttatatgcctgttttgcagtcacgggcctgccacaagcaattaaaactgataatggtctggtttatatcagttctcaaaacattcctggatacatggcatattgctcactccactggtctcccttacaacccccgaggacaggctattgtggaatgagccaatttatatataaaacaggcctttcaagaacaaaaagggggagacacagaaataaaacagacacttttttttccccactgtacagcaaggggatcaagttatccttacatgtatacattacaattacattttttccccaccctttgttctgttgcaacatgagtatctagacaaagttctcaatgctactcagcaggatctccttgtaaatctattctaagttgtgtctgataagcccaagctcccgatccctcccactccctccccctctcatcaggcagccacaagtctcttctccaagtccatgattttcttttctatggagatgttcatttgtgctggatattagattccagttataagtgatatcacatggtatttgtctttgtctttctggctcatttcactcaggatgagagtctctagttccatccatgttgctgcaaatggcattatgtcattcttttttatgactgagtagtattccattgtgtatatataccacttcttccgaatccaatcctctgttgatggacatttgggttgtttccatgtcctggctattgtgaagagtgctgcaatgaacatgcaggtgcatgtctcttttaagtagagttttgtctggattgatgcccaagagtgggattgtggggtcatatggaagttctatgtatagatttctaaggtatctccaaactgttctccatagtggctgtaccagcttacattcccaccaacagtgcaggagggttcccttttctccacagcccctccagcacttgttatttgtggacttattaatgcgggccattctgactggttgtgaggtggtatctcatggtagttttgatttgcatttctcttataatcagcgatgctgagcattttttcatgtgtttgctggccatctgtatatcttccttggagaacagtctattcaggtcttttgcccatttttccattggttgattggcttttttgctgttgggttgtataagctgtttatatattctagagattaagcccttgtctgttgcatcatttgaaactattttctcccattctgaaagttgtctttttgttttcttttgggtttcctttgctatgccaaagcttttcagtttgatgaggtcccatgggtttatttttgctctaatttctattgctttgggagactgacctgagaaaatattcatgatgttgatgtcagagagtgttttgcttatgttctcttctaggagtttgatggtgtcctgtgttatatttaagtctttcagccattttgagtttatttttgtgcatgggtgtgagggtgtgttctagtttcattgctttgcatgctgctgtccatgtttcccagtaatgcttgctgactagactttctttttgccatttaatattcttgcctcccttgtcaaagattaattgaccataggtgtccgggtttatttctgggttctctattctgttccattggtctgtctgtctgttttgatactagtaccacactgttttaatgactgtggctttgtagtatttcttgaagtcacaacagacacttttgttattttattttattttttttatttttttaatttttgttgttgttgttgttgttgctatttctttggccgctcccacggcatatggaggttcccaggctaggggtcgaatcagagctgtagccacaggcctacaccagatccacagcaacgtgggatccgagccacgtctgcaacctacaccacagctcacagcaacgccggatcgttaacccactgagcaagggcaggaaccgaacccgcaacctcatagttcctagttggattcgttaaccactgcgccacgacgggaactcccttttttatttattttttatttgttatttttttaatttttgttgttgttgttgttgttgctatttcttgcacagcagacacttttgaagaaaaccttattcactttaaattttttaatttggcccctgatgaaaaaatggctgcatagagacattttaatacagaacaacaaaaaaaataacttccttcaggctgaacagcccttgatttggtggcaggatccattaacaaacttctggtcccctggaaaacttattacgtggggtaggggatatgcttgtatttcactaggtcatggattacaacctgtttgggttccatcaagaagaatcaaaccatatcatgagtgagcctgtgaagcatccctttactccagaccccaaaggacaatgctaaggggctcatcttcccacttgaggtcagatcaaacatctaaccagagaggctgaaaatctattaggagaaggactcagaaaggcattgaaaaaacataaaccaaggaacccagaaaatatgaagggccaaataatgttaaggataaattcatatcttaattggtgccagatatatggagaaagccccccaaaattggcttttagccctgatcaggacctggagcacctccccagaataacaactcaaatatgttataatcagggccaggaagaatgaaaggagagcaagaggagagatagagaaaaggctgaggctctaataagtcaacctgggagttcccaatgtgcaagggctaaggcagagatctatgcccggagcctatttcctaaagatccctggaagagggactgcctttgaagatgaaggtctctgtggttgacccctcaggtctaggatcaagactgatgggacttttccataatggcccctgtcattatcaccattcaggagccctgtgtgactctaaatgtaggaagacagcctattgacttcgttttgaatatgggagccacttttctgtcctcctctccaatcctgggccccttattcataaatctaccacattcttatttctggcaagctggttataaaatttttttacacaacctttgtgttgtgactgggaatccattttcttctctcaatgtctttcttattgttccagggagttcaactactcttttggaaagaaatattttgtgggaggttggagcctcaatttatatgccaatggagcttaatcaaggtttatatctgccttcaatggactagatttaatgatgcctttaatttctgcatttccttgactaaggccttgctgttataaaatctaaatgttttattcctgatagttcatagaatgtgtctcattccctgctagatcttcaacagcagattcatgagctgtcctattcagctccagcttttgcagctggctctgtggaaccagctgacctcttcctcctggtgaaagtatttattcaccatattcattgtgatcttgatccttttgttcagaccctgtataattaattgtacttcttgcttcattacatcctaagagctagcaatgttcaaaggttaatgaaagaggtattcaaagcaatgtagcaaactcacttgaccattccatgagtggagatctaactgctttccctaacaatgacccttttcagcaggaagaagtcagagtggtcatcgcccctttttcccacagttagagtctccaactcagggaggaattaaggcagaatattaatagtataggaatatgggctttgatgcattttttgtgattattaattaaagtttgcagattaggggtcacattgaaacctcaattactgtaaaggttacagttgttgccccatggaactgtcctctgctactacatcatggtctggaagtctgcatccaaggctgacatggacgcctgggaggctatatatagcaccttgagaatcttctcatggtcaagttctagagactcccttcaccatcatgagagagtgctaagccttgctctggccatccctggaaactggtcagtctaagcatggctaaagcctgaagagttccacagaagacttaacttggaactcatgttctatctatggatgcatgaggcaagcgatttaagaaaaaataagttgcaagatttatttttgtcctcctgcaaaaacaaaaagtggggaattcccgtcatggcacagtggttaatgaatccgactaggaaccatgaggttgtgggtttggtccctgcccttgctcagtgggttaacgatcaggagttgccctgagctgtggtgtaagttgcagacgcggctcagatcccgcattgctgtggctctggtgtaggccagtggctacagctccgattggacccctagcctgggaacctccatatgctgcgggagtggcccaaagaaatagcaaaaagacaaaaaaaaaaaaaaaaaaagtgggagatgttgcaagacatgtttccctaatcttcttccttgattgttgagagaaatgtttctctaattttccttgattatcctccaatagcctctcctcacgtgatctcatttaagaaacaataaaagcggtgtggtttctagaggtgaggctcttggtccctgagaccttgagtcccccgggttcccaccttttctctctctctctctctctctctctctctctcttggtcttgttatttttgtgtcctgttgttttgttatttttttccttaagttctgtagcacccgttcttcagccgca

SEQ ID NO: 142 - DNA, 5017 bp, Artificial
  ss1186 sequence
  misc_feature (1361)..(1362): n is a, c, g, or t
tggttctgagatctaggaggatctgcaaggtgaccagagtatttggcagcagtagcagcagcaggatgcatgaattcccagggggatgagagcaataacagcttgcatttgattgcaatgctctcctctgaggtgattgtagccgcaggtggtgcctgttcagggacctcttgtgggagttggccatgacattttctaacatcagtgataactgcagtggtttgcttctgtcacctgtagattctgcatgaagcaatccatctcacttagctctcattacaggtgttacacaggctgatcctagttgcagggtcctgggaagtgacagagatctggcatatgggtactgcctggaacattcagcagtggcagcagcagtgccatggtgttccccagggtgcaagagcaccaacagctcgtattcattcagaatgccctcctctgtgatgaccttgaggtgactgggctgcaagtggtgcctgtttacctacctctagtcgtgctgggctagtgccatctctggagccagagataactgtgacagtttgtccctaccacctataaatcatgtgagaagcaccttgtcctgcttagtcccaataggatgtgctacacaagctgctctttgttgtaggttccttggaagggacattgatcaagcatctgagcactgcccagaacatttggcagttgcagctgcatttgcaggccaggtgtgctcctgggggagcaagagcaacatcaggtggtgttctgccataatgtccttctctgtgatgccctctgaatggttggggctgcaagtgatttttgttcaggtatccccagtggtggtgggccatgcccacctctggaatcagggacaactgtggtggtttgctcctgccacatgaaggtccagtcctctgtggggtagcaagtagcctcctgctgccagagacacctgaagaggcccagtctggagaggcccagtctgaggtgggccagtgagtagcttcctgcagctggagatgcctggtctgtggcatatggaaagcagcttctggccacagtgggggctgcactggggatgctctgccctctgtaagccagtgggcatgtgctcccactggggtgcaagaagttccctttggcagtcctcccctgcccatcctccctgacactggtgccttgcctcttctgtgagtctgtactttctccagggttccctctgccatggctttccactccccagcccttagtgaactgctcccccagcccatggtgcactgctccttagccccttaggctatctccacactgccaaacccagcccactcctggggactgacttctggagcctaagtctcagcacccagccnnccatctgagcatctcaggctgtggttctttgccggtggttcagacaatctatgcatctctcactctcctttttcattctcagacctgccgctgcacttttctcagaatctttgaggtccctctgacttggctgatctttctgttggttaggtggcttccccagatgtgggttccttttctccctcacagctccctctcaggaatgccagtcccatcctgattccttttatctctctctattttttctttttttccacccagttttgtcaagagtttcttgccctttttggaggtttaagttctgccagcattcagttgatgttctgtgccagttgttttacatgtagatgtgtttttttgatgtgtttgtgggagagggtgagcatgacctcttactcttctgccatcttgccttcacccctccaaacacagtctttattcatagtcccaaggactagtttggagttcaccttaaggatcccttcttctgtataccaattcaccgtaattctcagtagctttgtgattttgaagagtctgagccagacactaatgaaacctaacaatatacctgtacttccttcctcagggattctgggacaacccacaactgtttttcaatgccctagctaagaaataaagagaaataaaattagagatggggactttattacaatacatagatgacctccttatcttcagcccctcaaagaaatcttcagacaataatactgtatagaccctcaggttcctgggctccaggggatataaagtatccccacagaaaggccaaatttcctcccagagagtcacttacctgggacatgttctaaatccagggaagcatgcctttatgacccagtgtaaggaaggaatcctccatttacaacaacacatacaaaaaaacagctcagaatctttttaggaatggttgggttttgtaggatttttatccccaggtttagtctcatggcaaaaaccattgtaggattccttaaagggaccaaacatggaacttctagattggacagggaacttatgaagaacattgatcagattaagactgccctgagtagtatcccaggcctgggatctcagatcttaatatgccttttactctttttacctattaaaagaggaaatagccctaggagttctcactcaaaatatagggccaattccatgaccagtgacatgtctctcaaagtgattggagtcagtggtctcaggatggcaaggcagtcttaagagctctatcaaccacagccctgttagttgaagaggccacaaatctcaccatatgtcaacccctagaagtaccgacacaccaggtcagagagcattagaaatgaaaggacatcaatgaccgactggagaatacttcacaaatactaggtctttcttctacactctcctgaagtaactcttaaaatatgtcagaccttaaatctagccactattatgccaatagaaagcccagaggaattatctcattcttgtactgagaccatttaacagatatattctagcagacctaaactcagcaaacctgatgctgcctggtttattgatggatgtagttatatacatgacaatatccagaaagcattgtatgcataatagatttacatgagatcatagaggctaatgccctgcctccccagacctcagcgcaaaagctgagtttatagccctagctcgatctctaagtctaggaaaagacaagaggatcaatatctatatggattctaagtatgaatttttgctgttatgtgcacatgcctctatttggaaacacagcagactcctgactacatgggtcttcctaactcagcactgccaagaaaccttagaactcctaaaagcagtacaataacctaaggaggtagcagttactcactgtaagggacatcagaagaggaattcagacaaaataaaggaaataatctgactgacaagacggctaagagtacacctcttaaaacccttcaacttaggctgctttacttccctatgtatcaattcccagcccacttttgccaccccagtgtacaaggaaataaagtgggctagaactaaaagataccaaaagggccccaatggatggtggattacagaacaaatggtaatcctacacagaatattacatggaaaattttaaataactccatgactctttcatctggggaaagatgctttgattaggctgagggagaaaaaaattttctagtataggcatttctcagattattttataaataacaaatgcctgtaatatatgcttctataacaagccaagaggaaaatttaggccttcacccctcctcctgcccattcaaagcaaaggaagttatctgggaaaagactgtcaaagagattttacccagatgccatccctcccagggatatagatacctcctagtttgtattgacactttcatggggtgatgggagcctttccaacaaggacaaaaagagctcaggaaatagtcaagactttattaaaagaaataattcctcagatcagacctctgaggtccttacaaagtgataatggtctctcttttgtggccaagataacacaacaaatctctcctgccctaggcgttttttatcacctccacattgcctataggcctcaatcatcaggaaaagttgaaaggggaaatcaaactttaaaaagatctctggctaggctctgtcaagagacaacagaaccttggacaaagttttaacaatcaccatcctgagaatcagggtggcacctaaaacaagtttaaaacttagcccgtttgaaatgacttacagtaagccattcttatctgaaaccagtgagctcattaattgcctaattaatctgtgacaggtcaaaaagctgatttcagaatatggaaatcattttttgtctgcccccagctaggaaataagccctattcaggttcagctgggagattttgtccttctcaaagcatgaaagcatggagggaagcatcctcttctgacaaattattgcccaggcggaagggcccacacaaagcccttctcagcactcctactgcaataaaactacaggggatcactagctgggtacactttctagaattaaaacttcccctcccctgagtcttcacagacatgggagatcttggacagccagcagaatctaggtgaatgagcaagcctcttcaggacctgaagcttttattcaagaggacaaaaaaacatcacagatataaggctgagtacctatagccactattctccttttgccctctgataccccagtccacccaaaaaataagtaatatgctgtggtggatttggttacctattatcctcctcactctccttctcactgtcaaaatcttttatgagtgctgctatagtgaaccacatagaccagggagggaaatcctctgtccattctgggtttgataagacacataccaaacctaagaaaacaccccacaacttccactctttctcttttgttccaaaaagttctagagaccctacttctgctcttgttctcattttatctgtccaatacctttggtcctaaggcctaatgtagaaatatagcataacagtcaataattccagattattgctgaaggggaaaatcccactttctgctgcaattgccattgccaat

SEQ ID NO: 143 - DNA, 6444 bp, Artificial
  ss1204 sequence
tactctgaagcaagagttttaactaaggaaacaccacccctccttcccaggcagctgaagaggcagctacatgtctgacagtggctctgctccccccataccacccttcttgtaatcttgtagcaactacatgccttatgtccttgctagcagctctgctagcagtactccaagccttgcttatcagtttggtttttgtaatcttgtttactcagcttcttaggcaggaacactgtctgctcagggaagggggagggccaggctgcttgtgggggaaaaacaagacccagaagtctatattgtataaaagctacccagaacaaagagctggtgctcagactctggaggcgactctgctgagccggcagcagtgctgaataaacctggctattccacatctctgagtgctgcttgtctccttccactgatacagtttctgcaacattttctggtatgttggccaggaagccaactactgagcttatcccttgtgccactgttgctggggaacccaggaaggctgaaattgctggcccagtgacaggcagatagtgaatgcctggcccttttgccagctcctaactctcacttggactgtactggcctcagctcatacctcttcctgaacagactcagaaggaaagcagaagcaggttccaggacaggatgtcagactggtgagtgccccagtgacacctgcctgagtcaggacccaccatatggcagaaggagagactgatcacctctcagtgaccagagggtcactcaggataggatttgttccctcaggatctggtggcctgtcaattctggtgtgtgtgtgtgagtgactggagagaacaagagcacatgctccagggtcttcagactatggagcctgagtgggtcctaacctgtagttccttggtgacctcataacgttttaaggctgtgtcagggtctgagggttctcttccctccctgtgagactggtccaggttcagggtttatatgaaccagccacatgccaagtggcaccttaaactcctgagtgggggacagtcaggcatactaaagtgagtgctcccctcctgtttgttttgtgatgttgtgacagagtgagaactcacacaatgggtaaatcagcttcaaaacccactgtcttagaatgtatggttaagaattttgagaggattctctggagattatagtgtaaaactgaattctggaaaactgtgcactctctgtagcctagagtggccctcgtttgggtcagatggccctcagaagtgtccttagatgtgcccatgatctgagcagtatgtaatgttctaacaggagaccctagacacccaggccaatttccatacattgatcaatggttagaagttgacaagttaaggcctccttggatttggttctgcgtcacaggccagggacataagttcctagtagctcagtccaaaaagaaaactctgcctcaagaaaagaatccacggagttcccatcatggcgcagtggttaacgaatccgactaggaaccatgaggttgcgggtttggtccctggccttgctcagtgggttaacgatctggcgttgccgtgagctgtggtgtaggttgcagacacggctcagatcccacgttgctgtggctctgagtaggctggtggctgcggctccgattggacccctagcctgggaatctccatgtgccttggaagcggcccaagaaatagcaaaaaaaaaaagaaaagagtccacctatttttcaaggagaggctgaggacttgccccctgtgccacctccctatatgctaccggcccctcctttgggggctgaaggtccccaattgcccacagctcactgcactatgtttcatctcctcctcctcctcctgaagtccccaaggcgatattgcccctgcagtgggattcaccagaaccagtgagccagtgtctctggtcaaactggggagcagccacctggtgctacaaatgcccttatgggaggcacatggactgcaacatatcattcctgatgggaccatacaaggggggaccagtcttctactgtcagcccttttccatgacagacctcctcaactggaaacatcacactccttcacactcagaaaagcctcaggcactttcaaccttttagaatccattttccagacacaccaccccacctgggtagactgtccacagctccttctcagtttgtttaacactgaggagcaccgacaaattgtaacagcccggaaatggctccagaccaatgccccaggggatcaactagatgaggaaaactgggtaagggaagtcttcctggaggaggggccccactgggattataacaccaaagagggaagaaataacttggagacataccaacagaccctctgacagccggcaaaaagcctactaacatggccaagaccactgaggtactgaaaaagctgcatgaaaccctggccaacttctatgagagagtatgcaaggcttttcgaatcttcaccccttttgatcctgaagcccctgagaacaaacggatgataaatgctgcctttgtgggccaagcccaatcagacatctgtaaaaagttacagaaattagaaggatttacagaaaagaaactaccatcatcagggccatgggtgcccaaacatgcaggcccatctgctgttcctaacagtgctggttagtaggccatgaggtagtacatgaatttctttacctactgactgcccagttcccttgatgggaagagacctgctggccaaaatgggagctcaaatctccttctctgccaatggatcagctcaactcaaattaacagaaccaccctctcctttaaccacggcactcgctgtaaggagggaagaagaatggcacctgcacccttcccctccagaagaagggaccattcccctggaactagagactgaatacccattggtttgggctgaaagaaaccctctgggtctagcaaaataccatgctcctctcttgattcatctgaaacctggagttcagctggtaaagctgcagcagtacttaattcccagagaagattgactgggaatccaggctcacctgaacaggctacttgagcacagacttttgataatgtgtgagtccccctggaataccccctcattgcctgtaaagaaatcgaggacacaggaccactgcactgttcaggacctaagggccataaataagaccacaatcacattgcacccatccatacttaatctatataccctgctggagctgatcccttccactgatgagtggttcacttgcctgtacttaaaagatgccttccctctgcctgcaagtggtgcctgctagtcagccccttgttgcctttgaatgggaaaatccacacactgggacaaaggatgactcacttggacaagactcacacaaggattcaagaacactcctactcttttcagcttcaccctggccactgacctggctgaatttcctggacaaaaactagactgtgtcttgctgcagtacactgatggcctctggctggccagcaccacacaggctcaaagcctataaataacaaaagctctcctctccctactaatggaagctgggtatcagatatcaaggaaaaaaggcacaaatctgtaaagacaagtcaagtatttgggctttaacatcatgtggggccaatgaatgctgaggactgaaagaaaacacacagtttgtgccattccagtccctcccacctgctggaaggtgcgtgagttcttaggggcagtgagattctgcaagatgtgaatccctgggttttcagacttgggcagacctctatgtgagaccctgaaaggaggagaaaaggctccccttggatggggatcaagccaggaggcagcatttcaggcaatcaagaccaaactcactgaggctctggccttagaacttccctatgtaaccagaaaactcaacgtctttgttcatgagaaaaatggaatggccttgggagtcctaaccaagaattcagacattggcagcggacagtggcatatttgtctaagcaaattgactcagttgtggcccgatggcctccctgcctccgagcactgccagctaccaacttgttagtaagggaggatggcaagttgactctgggacagagagcctcaatgttaaagtcccatattcagttgtagtactgatggacaataggggccaccattggctcatgcatgcatgaatgactcaatacaaagagttattatgtgaaaatctgtggataaagctggaagttgtatgaactccaaacccagccacttttctaccagataaagcggtgtccccagactcaaactgcttagatacactagatgaagaattttccagcaggcctgacttaactgataaaccacttcaaaaatccagacatggttttatatactgatggcagcagcttcatggaggatggaaaaaggatggcaggatatgctgtggtatctgattcagaagtgatggaagcagaagcattcctcaggattcatcagcacagagagcagaattatgggcattaatcagagtgctggatctcagccaagaccagagagttaatacctatactgactcatggcatgcctttacatatcttcctgctctctgctcctctctctcccaacagtgcataactagattgcaaaataattctttgggtgagaaaatggaccagcatttgtagccaagatagtacagcagatggcaaaagccttacagatcaggaggaagctgcattctggctatcgtcctcaaagctcagggaaagtagaatgcatgaactgaacctttaagaagattctagcagagttatgtcaggagactggcttgccctgggtagatatgctggtagccctcctaaaagtaagatgctcaccccaagtgaggataggattctcaccatttgaaatcttatatggaaagccacctccactgatcagtttgagaggaaacaccagagaattgggagacttagatttacatagacaactgcaaagattggggctcacactctcacaaagaaacaaatgggtcacagatagaatacctatatctttacgcctaacagtacacccccacaaaccaggggaccaggtgtggataaaggactggaaaaaggagcctttaaagccggtatggaaagggccctatactataatcttaaccattcctactgctctcaaactgacggggagagacacctggatccatcactccagagttaaactggctggcccaactgatgactgtggggaatggagagctgcccttgatcaggagaaacctctaaagctgacaatacagaggaagagacaataatctcaaagccctgctctgaccataccagaagcttgtcagtcaacgcacagatgaagcttgcagaattggctgtccatttatgtttgttgtttactattattaataattactattattaattattatccaccttgactctgtcaggatccattctgatgggtgcagatgcaccctgaacatcaagaggggggaatgaggtaagagttttacctaaagaaacaacccccccccactagctgaggaggcagctacatgtctgacagtagctttgccccccgccccataccacccttcttgtaatcttgtagcaactacatgccttatgtccttgctagcagctatggtagcagtactccaagccttgcttatcagtttggtttttgtaatcttgtctattcagcttcttaggcaggaacactgtctgctcagggaaggggtagggccaggctgcttgtgggggaaaaagaagacccagaagtctatgctgtataaaagctacccagaacaaagttaccctggtgctcagactctggaggtgactcctctgagcccgcaatggtgctgaataaacctggctattccatatgtctgagtgccacttgtctctttcctctgctacagtttctgaaacaacttatttgtgtgaatctaagccttactattggtctgtgaatttattaccatagtcaggagaaagtgctgccattaagaaaaaagtcctcaaggtccacgtctagaaaaacaaaattaaagatatccctgtatccttttacttaccttaatgattctccttttcattctttgtttcctagccttttacatagctgggacaccaccaggtagtagtcatgcttccattccttttatacatcctgctcccaactcctttaattccaaacatcaaagaatacctggccaatctttcattccaagtctttataatgagtgatgtgctaatatcatatacattttggaggaatgtcctacagagctttgtaatagagaagaacaaatctggctccatatttgatttgttaattctattttaaccttactttaaactttgtcctctgtcacttgtgcttagtcatcctggct

SEQ ID NO: 144 - DNA, 9228 bp, Artificial
  ss1084 sequence
tgtttggccagagaaccctgtttcccaccccctccttcaccctacctccagggactgcacccccttatactaggtatctccaaagccccacagtgggtctgggaacatctaatcagtgacttaagaggggaccttataactcggaccctcttagcatttcccctcacagcccccataaagattggttcatgtttcagtgagggtgcctagaccacttggtgtgtcctagatcttatgggatctgcatcacaaccaaccctaggaggaggccattgggaagctggaaacaaactaaaaataccccataggggtaaccaagcctctgtcccaggatgcatcctccataactggaaataacgactcactaacaaacagcttcttctcttttacagcacccctatgaacagttatatggcaacaaatttgacaacctagaagaagaggacaactttctagagatgtacagcccacaaaaactgaatcaagaagaaatagatcaactgaacagaccaaacactagaaatgaaattgagtatgtaataaaaacactcccaggaccagatggcttcacaggtgaattctaccaaacatacaaagaagagcttagacccatcctccttaaacttccaaaaggtgaaagaatactcccaaagacattctatgacactacaatcaccctaatactaaaaccagacaaagatactaccaaaaaagaaaactataggccattatttttgatgaatacagacacaaaaattctcaacaaaattttagccaactcaatccaacaacatataaaggcagtagaggtccatttttcagctggacctctactgccagcctttgaagaaaatgggttgagatcccctatgtccaattattcatgaaagcatgaggctttttgcaatttctctctcctggattggaacctcagcctgaagagccccatgacttcctccctctgccatgaggagctgctcccttttggcagttcaccggagactcctacctcatttacccccaaccttccctagttccctgatactttttcctccctccagttcacccccaccctacctggtaccctggtcccttccctgactttcctcccttcatctctcagcgtgcctccctcagggagtagtccaaagcaaacctcaagtggcacttagtaccagccccctggaatcgacatgctcttccctttttgggagatccccaatggagagggcagactgacccccactgtatgaacccttctcctcccaaacctatacaactgtaaggatggatctaagggtttgagggaaatcctccaggaagtccttaatttactccagcgaatagtccacactcctttccccacttgggcagaaaccttcctgaacatcctatcctcaggggaagaaaaggcactggttctgactgttgccagggaggaagctgataaggccaatcaaaataatgcaggacatgctctatgccagccttgaatctgggctgttcctgacctggaccctgggttgggaccgttgagaggaacatggtcagcagcatctcacacatttcagggatgtgatccttaatggcatgcagtgggctgggaagaaacccataaattggagtagggtttagggagtcaccaagggtctgcaggaaaccccttggctttcctagaatgcctaagggagtgcctttgtgtgtacacgaacaagagccacctggagccagtggaagggcagaccattcttaagtcccatttcacttcccagagcaccccagacattgggagaaaattatagaagttggagataaaacccaccacacctacttcccaggggtggagttagtgtttccagtattcaacaactgggatctggaggtggatgccaaggaagatggacaagcggccttatctgccagtattctggtctcagtgattcagggtcattcaacccccaccacctaacgtgaacagaagggctcaaagccaatcagcatgcagctgccctaaggagggccactggaaggggaatacccccaatgtctcaaaggaatctaagggaaccactgggtcctggcccattcttgatggttgcacacatgaaagaagaagattaaaggggccttggctgaccttgactgtggggggtaaggaggttgactttccagttgacacagggaccacctactcagtctctctttttttggttttggttttgctttttagagctgcacctgtagcacatgcaggagtccaataaagagctgcagctgctggcctatgcaagatccgagctgcatctgcaaccttacaccactgctcatagcaacactggatccttaatccactgagtgagggcagagatcgaatttgggtcctcatggatactagttggattcattaccactgagccacgatggaaactccacacttactcagtcttcaatgaatacctcacaaggcaaaatgaccaaagataaatgttaagacaatgggagtggaagggaaactacaggaatgcaattttatagagttctgggaatgggtttggaagggagaatgttatctcactcttaaatatactggaatgcccaattcccctaatgggaaaagacttactatacaaattgggagctacaatttatctcagagacaaaaaccttaccactgaaatacctaagactcccttccattctttagtcctagggctactgccctctgccaagagtaatggcccggttagtattgaggagttaatccctcagtatggttcccatgtcaccatgggcagagccaggaggataccactggttggttgtatttaagctgcagcccggccacaatcacccaaataaaaataccccttaagcaaagaagccctagtggcacaaagcctaggcaaacaagggcttcttagaccctaccagtccccttgcaaacactcctattctgcctgtaaaggagtcaaatgggatacccacagctacttcaggacctctgggccagaaatgaagctacaaaagagtcaccctgtggtgccaaatgtacacattactctctgccctgatctctgagaagatgtgggcttcagtgttaggcataaaagacaccttcttttgtgtgcccctaaccccaaaatctcaagacatttgtgcatttgaatgtgcttgaacctggacaacttgagaagataaaagttgtgctggatggtcttgccccagggccttaaaacccccctacccttttagaaagatttgagctgaggaccttggtgaccttgagttagaacagacagctattctccaacaagtacatgacatcttaattgccagccccaccaaaaagctttctctcatgatatggctagtgtcttaaatcactataaagtttcaaaggaaaaagcccagatctccctccagtgggaagaatacttagggtttgttacagaaaaggggcatggggcactagttagggagaagaaggagttgatttaccagatggcagccccccaagagtacaagaaagcagccccagggttttctggggatgggagggttcttctgcatatggatcccaaactttggtttaattgctaagccctttatgaacaattaaaagggaaggaccctttctagtggatccctgactttgtccaggctttccttgaaataaaaaatcatctcatgaaagctcccatgttagatttacctgaccagtcccctccatctatatggacacaactacagccccctctcaagcaagcatagttatgttaacatcagaaaaatagactttaaggcaaaaaacattactagagttaaaggagacacttaaaaagatataaggtacattcaacagaaagtcttaatttctaaacatgtatgcatctaattacataacctcaaaacactaaggcaagggccaagagaactacatggggaatggacacatatttgattctagtgggaagttttaactgcctgggagtgcttacacaaaaatgggacctctgactccgggttagcttttttttttttttttttttttctttaagaattggaccaaacagctgaggctttgccttctgtctgttctccctataaaggtgagttatctaccctagtcagagcactagaacctgggaaaggcaaagttgtcaccatttaaactgactctaaatatgcctgttgaatccaacatacccatggggtcagctagatggggaaaggaatgctgacctcagaataaaaagattaataatggggggggggtggattatgcagctgctggagggtatactcctgccaaaggagtagcagttattcactgcagaggccatcaaaagggagaaggaggaattataagagggaataacagagcagatatggcagttacacaagcagcaaagggtgcagacagacttcaaatgccactcctaccatctcccccactccctaactccaacactcccatatacaccccagaaataagggaaaaggctttgagatggggctgtttttgttttggccatgcccacagcatgcagaatttcctagaccaaggatcaaatctgagccacagcagtgacaatgccaaatcctaaaccactaggccaccaggaaactcaaaggtggggttgttttaaaaggcataatacccaggtagctggttaatggtcatgggcagctattctcccatcagccattgctctctgggaaactcactagagcatactttatgggcaggaggccctgtatcaacagcttatccaatccatgactactcccaatttctgcagtctacttaaacaggtggtaaaagctgccctatctgcctctggaataagcccaacacacctcccccgacccaaggccaagggagtgacccccacccagtataaaggcacatatgcaggttaagactggcaatctgatttcacagtaatgccctggggcaattaaattttagatatatcctggttttgttttgttttttggccacattcatggtacacagaggttcccaggctgggaaatgaactcgaaccatagcagtgacaatgcctaatccttaaccatgaggctaccagggaactcctatgctggttttgacaccttctccaactaatggagcattccccactcaaacagagactgcttggaggtctaaggccttgctcaaggaagtaatcttcagctcaggctccttatatccatccagagtcacaacgggcccatgttattttcccaaattactaagagaaactctagagctctacgaatcaaatggggttcacacgctacttggaggccacaatcctcaggaaaagtagaacaaaccaaaccctcagcaaaaatttaggaattctcctgtggttcattcatcagcctagatctcccttctccccacagcacttttgagaatgcaaatggcccccaaaggaaactcaggttgagtccatatgagctcatgtacaggaagcctatcctgaagaacccagctccaagaccaagcctagggctatggactggtgaaaacagaccttacagagagggggcagaatcaaagctttacacacctcaggaatccagaactgcctctctcttctgatatggattcacatcttttgtcccctaggattgggtttatttggaagcctggaaatccataagagcagttagaccccaagtggacaggaccgtatttagtaatcttgaccactccttcttcttttttttgtttttttgttttgccttttctaggggtgcaccagtggcatatggaggttcccaggctaggggtctaatcagagctgtagccactggcctatgtcagagccacagcaactcaggatccaagttgcacctgcaacctacaccacagctcacggcaacgctgaatacttaacccactgagcgaggccagggattgaacctgcaatcttgtggttcactagtcagattcattaaccaccgagccacgacggaactccttgaccactccttctgccttgcaatgccagaacgaaagtccgtggcccaccatacctgagtgaagacggcacctatgcctgaggaagaagttactgagccacccactcaatacacctgtgaacctgtcacagaccttaagttacttttcaaaaggaagaacttaccaataaagtaatgtggtagacagacaggcttagtagttggctttttctttgccattgccgtacttgacttctgttgttctgccaaaactcctccctctgtcaacacttctgtccatgctagatgtaggggaatcttcatactggaagcaggatgagtggccattattgtctattctttctgatctcctctgttccatctcttctgtccacagggaataggaattcaatgcaatagtaaatttcttagggattatagcccatgagcaaaatctatcccggtgctggtctgtcacttccacccacaaagtgatccctaaggattaaagatactacatttcatccctaagaatgacaacctcactctcaccttggctaacaggtctgttaaccctaccccttttgaagttcatatccagtcgctaatgcatcttcacagcttggatctcgccccttgaattaacatctctaaagaatacaaagtcctcactctgaagtgcctcactgcccctaccaaagggaggaacttgcagtaacacctggggcttctctggaccctggtcaatgcctcttccattactcacagtttaagggcccttgggactgaatcctatggaaatctcacccactggtgccttctgcactgactcaatgaacacacacagggacaagacaggagatgtacttgctgggaaggaagacgtcggttgtctggtgttagcattagtatgtagccctcctgacgcctgtggaaaagccactagccaagaattgcccgtgtgggcctctctcacactgcaaaggtgccttctctcgggctagctactgatggaggtggttcagttcctcagaagtgtgtcaggcatgcactccccctgggtacttcttcctttgtgtcctaagagtaaacaaactgctccatcagaacaaccctaatgccttcccttctccaagatgggccatagccaacccttgcttagataacgtcaaatctgtgcacaatgcatgctgggccggctgagttctaggaacctaagtatcaccattcataacatcacccagacctgagataaaagggcaacagaactcattctggcaggagtagggattgcttttggactggtggccccctggggaggttttgcataccatgaaatcactctagaaaacctcacatggccccttgatgacttgttgaaaattatggaggatgccttacaaggactccatacttttttggactcactagcaaatgctgctcttgacagtaggctagctcttgactatttcctggctgagtgagcgagcttctccacagttattaatcaaacttgctgcaagtaggtcagtaactctggtcagattgagggaaatataaaagagatacacgagcaagctcaaaggttacataaatataacacacagcgtccggatccaagatccatctggattatggttaaacggcctccccagtttgacctgttattttccatttcttggcccactaactgctgttatcctcctgcttatgttcaggccttgcttccttaactgccttgtcaaattcattagtaaacagcttgaagccatcaaacttcagatgatattaccacaagggtataagcaactgggactacagcctggcgaccatcagacctattttaggctaatcagggaacagttctgcttctttaatctaggggaacactatgcccatgttcagtaggaagcagcttcagaaggcagagctttgcccttcagcacccctcaagagtgaggagcaggaacaaggaagagaggattttgttgccagagttgtgccaaatctttgctccaaacctatcaacccctgcttgaaatggaaataccatgtacctttatgtcacaggatccagagatgaaaggaggaagctaaagcaagagacaaaaaccagagagaacttgctgaaaccaaggaggcagggaatctgacctctgcccctcagtctcattctatgctgatcttactatgttagctactagatgacacacgttggccatgtggccacgactggaagatgcagaccgaaaaaggatacaaagggggtagcaccccatgtccaggaaagccctgccccttcctggggagattaatgcatatgccttcacatcattagcctcactcctccctgtctttaaaatctaatccctctcaccatgtgggcaagaagttgccaagttcctgcttctccattctttggccatggaataaaacttgggctgcatccatctcagcttcggttttgtttttttggctacacaaacccaaactagcatctattctatactttcttttcattcttgtccttctactaataacaagcattactgaaaataacgtcttaaaaagaagcctttgcagtatatttatgaccctggttttataaatcagaaaagcagaagaatatatctaagactcaaggaagaagctccagctccaccttcagctcccaaagctgaacttctacttcaactatttccctgaacaatttacttttggggcattaacaccatctttaagcactaggtgttaaaaatgacataaaaactgacattactctgtattttgtgcattacatgcccctccacaggtgtaaggaaaatacatatgcttcactacataatcatgcattaattatctaccctatataagcatgcacttcagcctattaatattacgggacacagtaaacagttcaatccgtatttgatttgagtccttatagaatattcacaggagtaactgaagtggttgatatcatgcaagacatgtttattgattgtacacaccacattatgtccaaatatttccagttatcacacttatcataactaataaccagagcttaatcagaaagccttaataaatcaccaagctgcccacaaaatccctctctcctcattttgggcccaagaaccatggggatttctgtaagtgaattttatctagtatctagtttttactgcagagccatctcacttaaaattgcccactccgtcctcttaaaaaagacatcttgatggactatca

SEQ ID NO: 145 - DNA, 8874 bp, Artificial
  ss1088 sequence
  misc_feature (7597)..(7696): n is a, c, g, or t
tgaaaacaaaagcaaagacaaacaaatgggacataattaaactgaaaaacttgttcacagcaaaggaaaccattaaaaaaaaaaaaaaaaagacaacctacagaatgggaaaatctttgccaaaaatgacaccaacaaggaattaatttctaaaatatacaaacagctcatacagctcaatataaaaaaaaaaaagacccaattaaaaaaaaaaggtcataagacatttctctaaagaagacatactgattccctttagccatatgaaaatatgcatagcttaacccgtgctgtgctatcacctagtgaatatttacaatttaagtcttggtggcacgatcatgcccaaattactgctaatcgtaatcaggttcgaaatcttccaattacaatggaacaattgttagggattggtccttggagtaatcttcaagatcaattaagaatgaatgatttggctattgaacagattagacaatgttgcttaaagacatgggataaaattgaatctaagggtcaaataaatatttcttttcaaaagatcctacaaggccctaaggaaccttatactgaatttctagctcgtttacaagaggcattaaaacgacaagttactaactctgaggtgtctgatactatttttcaattgttagcatatgaaaacgcaaacactgattgcaaaaaggccataggatttttaaaaggaaaagctaacatagccgaatatattaaagcctgtcagggagtggggacggagtcctttaaggcctcaatgctagcccaagcaatggctaatttaaaagttaaagacaaattttcaggaaaatggtttaattgtggtaagacaggacatattaaaaaacaatgtcgcgctcttccacgagcccgacctttctttcacggagcttcagcacgttctagtaacaataataaacagcccagactatgtccaagatgtaataaaggaaatcactgggctaaccaatgccggtccatctttcataaagatggaacccccttgttgggaaactaccctcggggcaagcttccagccccgtcaaccaaggaagctttccccattcagaacaagagccagactccctggaactacgctctgcaccagcgttcgacatcacagtagatctccctagtttacaggatttaatctccttcctagcgaaactcctacttctatgacaaccaagttggaaaatccattaccatcagatacaataggattgataataggaagggcagaactaacagaacaaggaattcgagttcataccaggatattggataataacggggatgataaagtacaagtgatggtttccactgcgattccttaggaaattaaaaaaggggatcggattgctcaaatcttaattttacctagagtccagaagaaaaaagacaggaataattttagacagaagagattcaataccacaggaggggcaggagtgtttttatcagaaaaggtcctagaggaatgacccacttgtcaagttatcataaatgggaaatcttttagaggattgattgatactggtgctgatgtttcaatcattagccatttacattggccagacacctggcctcttcagccagctgatattgaagtcactgggttaggaaaagcagagggtctcaaaaagagtgcccaatggcttaattgtgaaggaccagatgggcagccagctagattgaaaccttatgttgctcaactctctatcaatctatggggaagagatttattacaacagtggcatgcagaaatttacttaccgccagtagatcaatatggtcatcaaagccaaaaaatgttgcagaaacagggttacattcctggattgggattaggaagacatcatcaggggagagtggaacctattgaatctgagattaaaatggacaaatctggtttgggatatcggccttttcattagcggccactgcttgtaaaaataattatgtttctcctgaacctattcgactgaaatggactatagaaaaaccagtttgggttgagcagtggcctctttcttcagaaaaattaaaggttttacgtgatcttgtccaagaacaattagagaagggccatatagaagaatcctttagtccctggaattcaccagtgtttgttatacagaaaaaatcaggaaaatggagattgttaacagatttaagaggagtaaatgctgtaattcagcctatgggtgcccttcaaccaggcctcccatctcctagtatgataccagctaactggttgttaattatcttggacgtaaaagactgctttttcacaattcctttacacccagaagataaggaaaaatttgctttttcagtcccagtggtaaacaatatagcccctagaaagcattatcaatggaaggtcctgcctcaaggtatgttaaacagccctaccttgtgtcagtattatgtggcttcagttgttgagccagtccgaagacaatttcctaaatgctatattgttcactatatggatgatatactttgtgctgcaccctctcaggagcagctgactgaggttttccaaagtttacaaacctgtctaaaaggagcaggattggttatttctcctgaaaagattcaaatgaaaagtccatatcaatatttgggaactgtggttgaacgtaccactgttcaccctcaaaaggtagaattgagaagagatcaaatctctacattaaatgatttacaaaaattgttaggagacattaattggctccgaccttatttggggattcctacatatgaattgtcaaatattttctccttgcttagaggagattctaaattaaacagaccccgctctctaactgcagaagcagaagaggaactaaaaaagattgaaagtaaaatacaaaactcccaactaagtcgggtcaatctaaaataacccattcagttagtaattatatcttctcctcattctcccatgggaatattaatgcaattagaaaatattctcgaatggctttttcttcccaataatgtcacgaagtctttgtctccgtacctggacttgatggcacaacttattctaaaagatcgcactcgctgtgtacaaatgtccggaaaagatttgaatcatgtaattgtcagtttaactattaaggaaatccaaaattgttttcaaaatcatataggttgggaaattgcctttgcagattacgtaggatcaatagacaatcaccatccaaaaaaccctgttatacaatttataaagcgtactcaatggattctgccaaaaaaggtgaaggagttacccatcattgacgcccctgtgatctttactgatgggactagtaaagggaaggccggatatgtggctaatcaatctaaaattataagagcacctggcctttcagcccaacaggctgaactaactgctgtaatccatgccttgagggattatcctgagcctatcaatattctttctgattcagcatatgtagttcatgctgccaaaatgattgaagctgctaccattaaacaaaatttacctgtcttgttatttgacttgtttaccaaattacaaacttttgtaagggaaagaagatatccattttatattactcatatcagagcacatactaacctacctgggcctctagttgcaggaaataaagaaattgactgtttggtgacacctgtgttacaagaagctcaacattttcatgatttaacacatgtaaatgttcgaggccttaaaaaaagatttggaataacatgggctaaagctaagacaattgttcgtcaatgtcctgcatgtcaaattattaacaatccttctcaatctgagcctggagttaaccctaggggacttgtcccaaatgctctctggcaaatggatgttactcattattcatcttttggaaaattgtcatttattcatgtatgtattgacacttactctaaatttatttgggctactgcgcagtctggtgaatctgctaaacatgttattcgtcatttgtatgcctgttttgcagtcatgggcctgccacaagcaattaaaactgataatggtccagcttatatcagttctcaactttaaacattcctagatacatggcatattgctcactctactggtctcccttacaaccctcaaggacaggctattgtggaacgagccaatttatatgtaaaacaggctcttcaaaaacaaaaagggggagacacagaaatagttaagtcacaacaaacacttttaaacaaaaccttattcactttaaattttttaaacttggcttctgatgaaaaaacagctgcagagagacatttttatacagaacaaaataagattaactttcctcatgctgaacagcccttgatttggtggcaggatccactaacaaacttctggtctccaggaaaacttattatgtggggtaggggatatgcttgtatttcaccaggtcatggattacaacctgtttggactccatcaagaagaatcaaaccatatcatgagcaagcttgtgaagcatcccttgactccagaccccagaaggaggatgatgagggctcatcttcccacttgaggtcaaatcaaacatctaacccgagaagctgaaaatctactaagaaaaggaaagcctctcactccaaataatttggtcctagctctctttactttggtttccatcgcagtgagtattctcacaactggcataggaatcattttattacttgtatagtacagggattgaaagcctcatgagtacaacccattaaaaactattgaaggttcaacaagagagtccatcagctttcttagcaagactcagaagggcattgagaaaacatacaaaggaacccagaaacaatggagggccaaataattcttaaggataaattcatatctcagccagtgccagatatatggagaaagctccaaaaaaattggcttttggccctgatcaggatctggagcacctcctcagagtatgttataatcggggccaggaagaatgaaaggagaacaagaagagagactgagaaaaggctgaggctctggttatggcactacagggagtcaacctgggagtttccaaggtgagaggactaggcccggagtctgtttcctctgaggaaaagagggaccctttaaatgggagtgccccaagactcagatactggaagagggcttgcccctgaagatgaaggtctctgtggttgacccctcaggcccaggatcaagactgatggaacatttccataatggctcctgtccttatcaccactcagccctggatgactctaaatgtaggaatacagagccacttttcagtcctcctctccaatcctgggcccctccctcatgaatctgccacatttatatttctggcaagccggttacaaaattctttacacaacctttgagttgtgactgggaatccattttcttttctcaatacctttctgattgtttcagagtccaactcctcttttagaaattcttaagatatggaaggtaactacatacacattgttacagttgtcaacattaggtataatatcttatcatacctaggtttaacagaagtcaaatgagacactgaaacatcagttactaaacagaaactaaaggtctttagaatgattaaccaatatgatcagtgccaccttgaaatggtctctataagaaaaacttgtttttagaaattataaaggagagtccatggttgctttagaaaagtagaatgagtgtgttttcaatatagaaggaatgaggcttattaaggcaaaagaaagatagtctgtcttaaaataagggacagactaatatggatacagaaagtgatacaaggtgtatgggaagtggacactgagaagagaattttgtgcatggtggggactgtttagaatatatttgagtaagttaactttaaagtgatgccataaatcatactgttcaaaaggacataaggtagctttccattgcatgctgaccaaggcatacaaatgtttcataaccagccagagaaatcagaagaatcatatgagttacctgtgctattataaaatctaaatgttgtattcctgattgttcacagaatgtgtctaattccctgctagatcatcatcaatagattcatgagctgtccaatccagctccagcttttggagctgccctgtggaaccagctgacctcctcttcctggtgaaaatatttctttgaggtatccaaagcaatgtatcaaagcccacttgaccattccatgagtggagacctaactgcttcccctaacaacgccccttttcagcaggaagaagttagagcggtcgtcgccccttttcccacagttagagtctccaactcaaaggggggaattaaggtagatttttaactcaggtagtcagtgtagggatatgggctttgatacattctttgtggctatttattaacatttgtaaactgagggtcgcatagcaagcccaactgctataaaggttgtaggtattgccccatggatccatcacatcagagtgaagaaggttgcatccgctgctgacatgacaccggggaggctgtacagcacctcgagaatcttcatggtcaagttccagagactccttttgccatcatcagagtgctaagccctgctctggccacccatggaagttggtcagtctatgcatagcagaagcccgaggagttccacgtgagacttaacttgaactctgagacttaacttggactgtgttctgtctaagtgaataattcaagaagaaatgaaaaaagttgcaagacctatttttgttttcccacaaaaacaaaaagggggagatgttgcaagaaaactccatcttatccttctttactttatcccatcgtcttgtcttattttatcccatcttccttctttggaaaaacagtcacagtgctggtaaatgacttaagcttaagagcaaagacctaaaggcataaatgacttaagcttaagtactgttatgtgcctagaggtcagagtaagagcttaaccctttaccacctaagtggctttttaaatagtaaaagaacttatataatagtaaaccctgtatcatccactcatagccactcctcacttgatctcacaataaaagcagtgtggtttcttgaggcagggtgctcttggtccctgagaccttgagtaccccgcgctcttggtccctgagaccttgagtccccagctcccacctttacttaagataaatgtctctgtgtcttgttttatgttaactatttttccttaagttccacagcaccgttcttcagccccatcctgctgagctggccccggcatgttactaatttcagaaatgcaaatcaaaactacaatgtgttattacctcacaccagtcagaatggacataattaaaaagtgaacataccccaggttcacaaggatggttcaacatatgcaaatcagtcaacatcatacacattaacaaaataaaagtcaaaaaccacatgatcatctcaacagatgcaaaaaaaaaagcatttgacaaagtccaaattccattcattataaaaactcttaccaaagtgggtatagagggaacatacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaattgggaacgagacaaggatgcccactctcaccactgttattcaacatagtattagaaatcctagccacagcaatcagacaaacaaaagaaatgaaaggcatccaaattagaagagaagaggtaaaactgtcactctattgagatgacatgatactacatttaaaaaaccctaaggactcaaccccaaaactacctgaactgatcaacaaattccacaaagtagcaggatacaaaattaacattcagaaatgagttgcatttctgtatactaacaatgaaatatcagaaaaggaatgtaaaattacaaaacctttttaaattgcacctcaaaaattaaatacctaggaataaacctgacaaaggaggtgaaagacttatatgctgagaattataaaacattcatcaaggaagttaaagaggattcaaagaaatgcaaagatattccatgctgctgggttggaaaaattaatattgtaaaaatggccatactacccaaagcaatctacagattcaatgcaatccctatccaattacccatgacatttttcacagaactagaacaaacaattcaaacattttatggaaccacaagagacccagaattgccaaagcaatcctgaaaaacaaaaaccaagcaggaggcataactctcccagacttcaggcaatagtacaaagccacagtcatcaagacagtgtggtactggtcggaaaacagacatacagccaatggaacagaatagagaacccagaaataaacccagacacctatggtcaattaatcttcgacaaaggaggcaagaatataaagtgggaaaaagacagtctttccaggaagtggtgctgggaaaccttgacagccgcaggtaaatcaatgaaactggaacacaccctcacaccatgcacaaaaataaactcaaatggcttaaagacataaatataagacaagacatcatcgaactcctagaaaagaacacaagcaaaacattctcttatatcaaccttacaaatgttttctcaggtcagtctcccaaagcaacataaataaaagtaaaaaaataaaccaatgggacctactccaactgacaagcttttgcacagcaaaagaagccattaaaaaaaacaaaaagacaacttacagaatgggagggagaaaatagtttcaaatgatgca

SEQ ID NO: 146 - DNA, 4472 bp, Artificial
  ss1105 sequence
caagagatcctacaaggtcctaaggacccttatactgaatttttagctcgtttacaagaggcgttaaaacgacaaatgactaattttgaggtgtctgatactatttttcaattattagcatatgaaaatgtgaatactgattgcaaaaaggccatagaatttttaaagggaaaggctaacattgctgaatatattaaagcctgtcagggagtagagatggagtcctttaaggcctcaatgctagctcaagcgatggctaatttaaaagacaaatttttagaaaaatgttttaattgcggcaagacaggacatactgaaaaacaatgtcgtgctcctccatgagcccgaccttcctttctcggagtttcagcaccttctagttacaataataaacagcccagactatgcccaagatgtaataaaggataccactgggctagtcagtgccggtccatctttcataaagatggaacccccttgttgggaaactctccttggggcaagcttccagccccgtcaaccaaggaagctttccctgttcagaacaaaagccaaactctcaactgaagcgaggttccctgggactacacctgtacaagcatttaacatcacagtagatccccttagtttacaggatttaattctatttcccagtgaaactcctattacaaccaaattagaaaaactattaccaactgatagggtaggattgataataggaagggcagggctaacggaacaaggagttcgagttcataccggtacattggataatataggggatgataaagtacaggtgatggtttccattgcaatcccttggaaggttaataaaggggattggattactcaaatcttaattttacctagagtacagaagaaaaaaaaaaggaataattttagacagaagcgatttaataccacaagaggggcaggagtgttcttatccgaaaaggtcctagaggaacgacccacttgtcaagttatcataaatgggaaatcttttagaggactaattgatactggggctgttgtttcaatcattagccatttacattggtcagacacctggcctcttcagccagctgatattgaagtcactgggttaggaagaacagaaggtctcaaaaggagtgtccaatggcttaattgtgaaggaccggatgggcagccagctaaattgaaaccttatgttgctcaactcgctattaatctctgggggagagatttattacaataatggcatgcagaaatttacctagcaccagtagatcaatatagtcatcaaagccaaaaaaagttagtgaaacagggctgcaaacctgtcgaatctgagattaaagtggaaaaaactggtgtgggacatcggccttttcattaatggccactgctggtaaaaaccgttatacttctcctgaacctattcgattaaaatggactacagaaaaaccagtttgggttgagcagtggcctctttcttcagaaaaattataagttttaaataatcttgtccaagaacagttagagaggggccatatagaacaatcctttactccttggaattcgccagtgtttgttatacagaaaaaatcaggaaaatggagattgttaacagatttaagaggagtaaatgctgtaattcagcctatgggtgcccttcagccaggcttcccatctactagtatgagaccagcaggctggctgttaatcatactggatttaaaagacttttttttcacaattcctttacacccagaagatagggaaaaatttgccttttcagtcccagtgataaacaatatagccactagaaaactatcaatggaaggtcctgcctcaaagtatgttaaacagcctaccttgtgtcaatattatgtggcttcagttactgagccagttcaacaacaatttcctaaatgctatattattcattacatagatgatagactttgtgctgcaccctctcgggagcagctgcttgaagtttttcagtgcttgcaatcctgtctaaaaggagcaggattgattattgctaccaataagattcaaatgaaaagtccatatcaatatttgggaactgtggtggaacatagcactgttcaccctcaaaaggtagaattaagaagagatcacattaaatgatttacaaaaactgttaggagatagtaattggctctgactgtatttggggattcctacatatgaattgtcaaatctattctccttacttaggggagattctaaattacacagcccccactctcaaactgcagaagcggaaaaggaactaaaaaagattgaaaataaaatacaaaattcccaactaagtcgggtcaatctaaaacagctcattcagttagtaattatgccttctcctcattctcccatgggaatattgatgcaattagaaaatattcttgaatggctttttcttcccaataatgtcatgaaatctttgtctccgtgcctggacttgatgacacaacttattctcaaaggttgtactcgttgtgtacaaatgtctggaaaagatttgaatcatgtaattgttagtttaactgttaaggaaatccaaaattgttttcaaaaccatataggttggcaaattgcttttgcagattatgtaggatcaatagataatcattatccaaaaaaccctgttcgacaatttataaagcgaactcaatggattcttccaaaaaaggtgaaggattcacccatcattgaagcatctgtgatctttactgatgggagtagtaaagggatggccggttatgtggctaatcaaagattatagaaatgcctggagctttctgctcaacaggctgaattaactgctgtaatccatgccttgagggactatcctgagccaatcaatattctttctgactcagcatatgtagttcatgctgccaaaatgattgaaaccgctaccattaaacaaaatttacctatcttgttattagatctatttacagaattacagactgttgggaaagaagatactcattttatatcactcatatcagagcacttactaacttaccgggacctctagttgaaggtaataaagaaattgattgcttggtaacacctgtgttacaagaagctcaacattttcatgatttaacacatgtaaatgttcaaggccttaaagagatttggaataacatgggctaaagctaagacaattgtccgtcaatgttgtgcatgtcaaactattaacaatccttctcaatctgagcctggagttaaccctaggggacttgtcccaaatgcactctggcaaatggatgttactcattattcatcttttgggaaattatcatttattcatgtatgtattgacatttgctctaaatttatttgggctactgctcaatctggtgaatctgctaaacacgttatgtgtcatttatacgcctgtttggcagtcatgggcctgccacaagcaattaaaagtgatgatggtccagtttatatcagttctcaatttaaaacattcctggatacatggcatattgctcactccactggtctcccttacaacccccaaggacaggctattgtggaacgagccaatttacatgtaaaacaggctcttcaaaaacaaaaagggggagacacagtaatagttaagtcacaacagacacttttgaataaaactttattcactttaaatttttaaaatttggcccctgatggaaaaaaaagcggctgcagagagacattttaatacggaacgaaaaaagattaacttccctcaggctgaacagcccttgatttggtggcaggatccattaacaaacttctggtcccctggaaaacttactacgtggggtaggggatatgcttgtatttcaccaggtcatggattacaaccacaacctatttggattccatcaagaagaatcaaaccatatcatgagtgagtctgcagagcattccttgactccagatcccaaatgataatgataagggctcatcttcccacttcaaacatctaaccagagaggctgaaaatctattaagagaaggactcagaaaggtgttgagaaaacataaaccaaggaacgcagaaactatgaagggccaaatagtgttaaggataaattcatagcttaattggtgccagatatatggagaaagccccccaaaattggcttttggccctgctcaggacctggagcaccccccccagaataacaactcaaatatgttacagtcggggccaggaagaatgaaaagagcacaagaagagagatagagaaaaggctgaggctctaatgagtcaacctgggagttcccaaggtgcaagggctaaggcagagacctatgattggagcctctttcctagagatcactgggagagggactgcccctgaagacgaaggtctctgtggttgacccctcaggtccaggatcaagactgatgggacatttccataatggctcctttcattatcaccatt

SEQ ID NO: 147 - DNA, 9243 bp, Artificial
  ss1117 sequence
tgttggagaccacagcaactgctgacctttgcaggaaacaaatatggcacacgtgcaaaagcacaaccaccgaggcagttatcatcacctgcccctgattttgctcattaacctacgtcaccttccccaataaaagtcatgtgagctaaagcctagacgcccttgttctgcagaacagggtgcctcctggtcccagctttctagatgtaagaggtttgtgtgttctgtatgccgctccctccctcttccaggatctcctgttgccctgcagtgctggtcgcagcagagtggcgcccctcgtggggctggaagaggaggtcggccacgagcagagaaaaaaggaaggtctgccacgagcaggaaaaggtgaaactacagacggcggagacgctagccttgcactcagcagagtcgtgaccatgagtgggcaagtaggaacttgaaaccaggataacaatggggcagaatcaatttcaggaaactaaacattacattcaattgcttaagtgtatgttgagacagtcagaggctcgggtaacagggtctaagatagaggaattgttggaagctgtgatcaaatataaccctaggtttccaggagagtgtattatggacccaggatcgtgggatctcatgggagaaaatttaaagcatgcccagcaatctggcctctctgtttgttttttctacatggggacctatcattccagctttacgtatatacgtaggggagcagtacgacgtgttttggaatacttgcgggagcataaagaaaaacctaggccttctgctccccctcagcctgatccctttcttgatgagaatttgaataagcctttagctgtggaggcaacactaactccccttcaatcagccctaaaatctactagccccgaggaagggacctttttagcatccctgtaacaactgcccccatcctcaggtcccacaatgtcttttctaacaaaggaaatcttggtgactccattttgctctggtttcagctgaaaagcccacctgcgaccccctcctccttccctcttctcccaggaacaatgtttcaaattcgccaaccgagaagaacatgggccctgacctgacccatgggaagggggcaggtccatcacctgcattaggcataaatagggagggtcttttctgctttgcgtgggcgctgtgagtaaagagcccttccgcagaagtaaagagccttggcgaggtctaccccgtgtttatgtgtccggttttccaacactggcgtcccgagccattctcccacaccagggcaaaatatccacatgcataacccttttgactttaaagctcttaaagctctacgggagggtggaatacagaatggagttacagctccttttactatgagtatggcagaaagcacggggacacttcagcttcccccatgggattggcacaggatcgacaaagccaccctaacggtggagactatttaatttggaagtctagtctttcaggttttttggtcaggaacaggctcgcttaaatcaaagaaataatgtcccagttacttttgaaatgttgcttgggaccggcccttttcttgacttagcaagccaactgactgacgatcctcgggcccatgagccgctgagcctggccacccaaagtgtgggtgacaagtcctgggagaggaaacccacaaggaccttctgcgcaaggtcctcaaggccctacagagccttgcccacagtttgtgcacctaactcgagccgtacgtcgccaagtagcacattctcaggtggctggtattttaattaaacaactggcatatgaaaatgcaaataaagcctgtaaaagggcagtggtccctgtaaggaattcaggaggcatctctgcgtttattaaggggtgtcaagatgtaggaagtagagggttatgctcaagcagagcttgctgcagcatggaaaggaacccttagctctggaaagatgttttaattgtggagaagcaggacattttcagaaagcatgctgagctcgattaaaagggaaaccatccctagccgcaggatcacccccaggacctggtcataaccctggttaatgtccgcattgtcagagaggaaatctttgggctaatcaatgtcggtttagtttcaccaaaacggctctcttaacaactccggtgtcaggaaatgggacaccatcaaccaatgagggcatgtgtggctcaaaccgaaaacgaatccaagcccttacaagggccactcccagtggcgcagggttggacttgccctgccccacagcagcagttttaacacgtgaacggggcgtagggctttccttcctggaatatttggctctcttcctcctgttaggccttaatgagaagggagaaggggcttaaccaggaaaggctgacactgttgcctggggtggtggatgcggactctcagggagaagttaaggtgatggggaggtcagaggccattcgtcctctacagccgggaatgagaattgctcagttgttcctgctgccgcatcttaaggtaggaaagagttgccagaaagaaaggggaccatcaggacttagatgttcggggacctctcaggtcttttggactcaggaagtcacaacagaactcttcaggttaatggaaagaatgtaaggggattaacagatattggagctgatgttttggttgttggttgtaatgactggcctcccacatggcctttagttacccccaaaatgaagttgagggattcggagttcccactacagtccaccagttggcagatgctttcctgggtcggaccagaaggaaaaacgggttattttaaaccttacgttgctgatatagccgacactttacggggaagagctctcttgtctgctatgagacttgattaacaacggaggatggctactgtggtgattctaatgattcttctcctggatggaaaccaatgaaaaagttaggatatcaaaaacaaacaggcttaggaaaaaacacaagtgcaaaagaacctacaaacttgcacattaagcttgataaacatggaatgggttcagtaaggatttcttaatgggttcagtaaggatttcttgaaaattctccactagcccttgcagatatgcaatggattaatgatgatccaatgtgggtaatcaatggcccctaactcaggagacattgactacaatacatgagctaatagctcagcaattgcaagcaggacacactgaggaaatgaacagcccgtggaatactcctatttttactattcctaaaaaatcaggtaaatggaggctattacatgatttaagagaaattaataaaacaatgtatggctgtgagagctttacaaccaggcttgccttctcctactgcaattcccttagattgggccttgttatagatataaagattgttttttttccaccataccgttagccactcaagataaatagagatttgccttttctgttcctgctttaaataacaaggcacctatgaagcgatatcaatggaaagtattgccacggggcatgaaaaacagccctaccatgtgccaaaaatttatggctggagcctgagctcctgttagacttgaataccctgaggcatatattatccattacatgataccatcctctctgctccaaaagaataagtttttaacatcttgctagataccaaagtatatcttaatgaaaaggggcttattatagtcccagataaaattcaaaagacccctccatttcaatatttaggaactttgatagaaggctgtactattcagccacagaaaatgcaaattcgcagggaccaattgaatacatttaaatgattatcgggagatgttaactggctaccgccatatttaggaattactataaatcaattaacgcatctttttaaaacatcgaaggccgatcctgaccttacctccccacgtacattgtctcctgcagccctcaaaggattacagctggttgaggaaaaaaggcacagaggcaatgtattgactatgaaaatccttttattctgattgtgttgccttccatgaattcacctatagcagccctagttcaggaactgccacacttgggcattgtcgagtggatccatccttctaatcaagaagtgaaaacaccagcacttggaggatcttagagctaaaactcttattcgaggcagacaccgtcctaaacaattgattggagtggatccaaatgtggtaaatgtccctctagacaaattggagagagactttattcggaacctcgttgccatggcagactgccttcgctggatatgcaggtgcacttgataatcatccacccgaaaactataaacttataaaattcctatgagaccttttatagttccaaaaggtaccagaccacagcctagtgctaaactctcattgtacagacgcagcttcaaatggtgaagctggtattcaaggtccaaatattactaaaattacacaaacttctgacccttcggctgaaaaagccgaactcgtggctgttcaacaagttttaaaaataatcttgtattcttgtaatattgtttcagattctcaatatgtggtacaataagtacaaaaactagaaacagcaaaattgaaagaactaaatgaagcattattccaactatttttttgcacacagcaaattattagaggacatcaccattttttacgactcatagacgttctcctacgtctttagcaggtgctttacatgatggcagtcaaacgcttctgttttggaagcggcccgtgcttcccatgcacctctccatcaacccgcagcaatgctgcgtagacagctcagtctgtcttgtgctgtcgcccaagatgttattaaatcctgtccatcgtgtcaaagcttagcccaagtgtctaccaatgatggagtcgatcctagaggattaaaaaggaatccactagggcaattggatgttactcatgttaataggttcagttgtttaaaatttgttcatgttaattgttgacatattcctctgttcttgggcctcggctcaggcaggtgaggcttgttgacgtgtcaaaaaccattgtggggaagcttttgctgttctgggccttccacactgtattaaaactgataacagtcctgcttatgctagtaaggcttttgctgaattttgtcaaatttgaggtattttatatgtcactggcactccctataatccccaaggacaagctatagtcgaacacatcatagattgaaaccgcaacttaaacaaagggggaacaagaagcctcctcccccacacgattattaagacgagttttgcttactttgaattttttcacctgtaatgaacaaggagtaatgcccatggaatggcactgtggccagcgttttcctggtacctcctcgttagcatactggaaaacacctgaggaaaatatatggcaaggccctgatcctttaataacttggggaagaggttatacttgtgtctttccagaaacagcggttacacctttttggattcctggcaggtgtgtgaaacagtggcacggagaaaggccaagtgacatgcgacttctggcgagtgaccctgggagcctggggctgacataatgctacgttagatcgtctggctttacaaaaggacacgccattcttcctgcccattttacaagccaggcttctgctgacagacgaaaattacaaacattagaacagaacccacaaactccattcctagtcttacttgacatggcctttaaggtctcagggaagaggcttgttttacccaattgtaccttattcatggctgaagctaaggaatgggaaataggaggtctttgttttgtttgtatgtctttgttgtgtacggatggcattgccaaaattcataaaagagctccacgtaattggcttaagggaaattaagcacttacacagaatctcaaaatacgtaaattaatttttggttcacgtgaactgcaaaaaatgtagtatttgatattcattattagctgttaatatgaaagtttgttaatctaggagttcctgttgtggctcagcagttaacaaacgcgatgagcatccatgaggacacgggttcaatccctggcctcgctcagtgggttaaggatccggcatggccgtgagctggggtgtaggttgcagatgaggcttggatcctgtgttgctgtggctccagcgtaggccagtggggcggctacagctccggttagacccctagcctgggaccctccatataccgggggaaacggccccagaaaaggcaaaaagacaaaaaaaaaaaaaaaaagttaatctaatatagacaatgtctttggagtcatcagcattaaatataatatcttattgtacccaggtttaatggagaaacgtaattgtattaagagaaaaagtaagtctgtcttatagcttgttattttgaatggaaagacaggagacagactaatacggatatagcaagtgacggaaggtttgtgggaagtggacaatgagaaaataattttgttcatggttgggactaagtttaaaatttcggtaaacgaatttaaaagtaaattcaagtgcaaagcttgaatttggacggccgcttggttcttcctggctccctggcaaacgcaataatgaaaaagaaatggttagaaaacgtgttttccattaggggtagactttctactgtcctaatttggctatatttggtaaaaatgcgggtaattttaaagaaaaagactgttttgattcatattccagttttgtgtgttgagattagtgtttactgtctaaaactcacctcccaaatagttctctaccactaagttacattactataaacttcgagttattaaaaataacttaagcttgtttctgaagccgattgctgtaatctgtctctgggagaatatcagatgtcccatggtgatggggggaatgcatgtgcattctggaagagtatcatttcaagggatgcctccagcctagataaaaggtttcttatcaggaattcgtaagttcaatattcccaaagaaagtgaagaaaattaagtctgtatttctcacttaagggcatctacattggactggtctatagagagaattactgacttcaaactgaccctaaaacaaggctctaataagaaaaacaccaatgcttggataaaaagaagacaacatcagaagtaggccactgtcccaagactgtcacatctgactcgtatggttatttgttttccttctgatttaccctgatgggcttctcccttccaaggctcttactattgatgttactaggtggcatcccctcacctggccagttaatacctgctctgacccagaccctaagtagagttttttctaacgttactcaaactcaatccgcaacaagtgagacttccgcccagggctataactttgccaggctatgttaatttaaatctaaaggctccttttgttgggaacaattaaaccatctggggataaccagcctaatcacactagagaattgggctgaatggacaaagccagtgtataatttcctttaaagataagaaacgactaaaccagctgaacagggtgaaagcccttcacttaacgttggagaccattgaaactgctgaacgaggcagtaaacaaatttggagcaagtgcacaagcacagccacgaagagctttatcattacccgcacctgattttgctcgcgaacctacgtcaccttccctaataaaaggcatgtgggctaaaacccaggggcctgtgttctgcggaacggagtgcctcctagtcccccactcttctaaatgtaagcgtcttctgtgcttcgttatgccgtgtccatccctctcccagggtctcccgttgccctgcagtgctggacatggcaacttaaatttttatttatgacttcactaatactgctgtatttttattaactgttttcacagaattgctgtttcctgtactgccgaatttgtaactgagtctctgataaaatgatagttccggatgaggtcagtggtctccagaccatgggaaaatgcagcaagcgggaatattttcctggaccattagagactagaaagataggtggtccagagacttttggctcctgtaaacaaggcctagtccagtaatagcacatggagttgcctattagtaaaatctttactagatctgggaatagtcattcctaccattgtgagacgaaatggccctgaaatgcctctcagactatagttgagtttaggaccatggggaaacactgcgaaccgaagtttggtccttgctgacatcagcctctacatggagtaaaacataagccactgcagctgccgaccctcagcgccccctgatcagagctcagcatggagaccgggagagaggcgctctgtgctctgggaaaactgacagaacaggccttcagagagttagatttaaggtaaggatttttgtatagacccaaacttcttgtgtcttctcatatctagaaaatcagacatcacttccagtggcatctgcattggccaatagaaaaaaaaggcagactagagtagctgtgggtcagacatccaaggtaacactaggaaatattccgggagtcactttagacaagtctttgtattgctaagaactttaaggtttatgtgacctgtcagacttgatgccaccagctcttctcaaagtagcatcagctggcagctgcaaccttatattttcaaggtctcctcttataacaacaggagaggaccaccgccccatcccatgtaacgagaggctggaatcaaagattccccggaggacggagacagaccccccgcctcccacacatgactgttcaacctggagacctgctgcagacgtggctgtagaattggattgacccatagaaaccaggtgaacgctctgcaaccaaaatgtcctgggactgttcttatgcagccaatacaaaggggagatggtggcgaccactgcaactgctgactttgcagtaaacaaactcagcgcacgtgcaaaacaccacctctaagatagttatcacctgaacctgattttgctcatgaacttacgtcaccttccctaataaaagccgtgaggattaaagcctaggcgccttcgcggaacagagcacctcctggtctccggctttctagatgtaagagaggcttgtgtgttttggtatgattctcccgccctctttcaggatctcctgttgcccttcagtgctggttgcaaca

SEQ ID NO: 148 - DNA, 8245 bp, Artificial
  ss1120 sequence
tgattggtccacggagcgcgggctctcgatattttaaaatgattggtccacggagcgcgggctctcgatattttaaaatgattggtttgtgacgcacaggctttgttgtgaaccccataaaagctgtcccgattccgcactcggggcccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgagggggattgttcttttactggcctttcatttggtgcattggccgggaaaccctgcgaccaccccttacacccgagaaccgacttggaggtaaagggatcccctttggaacttgtgtgtgtgtcggccggcgtctctgttctgagtgtctgttttcggtgatgcgcgctttcggtttgcagctgtcctctcagaccgtaaggactggaggactgtgatcagcagacgtgctaggaggatcacaggctgccaccctgggggacgccccgggaggtggggagagccagggacgcctggtggtctcctactgtcggtcagaggaccgagttctgttgttgaagcgaaagcttccccctccgcggccgtccgactcttttgcctgcttgtggaagacgcggacgggtcgcgtgtgtctggatctgttggtttctgtttcgtgtgtctttgtcttgtgcgtccttgtctacagttttaatatgggacagacagtgacgaccccccttagtttgactctcgaccattggactgaagttagatccagggctcataatttgtcagttcaggttaagaagggaccttggcagactttctgtgcctctgaatggccaacattcgatgttggatggccatcagaggggacctttaattctgaaattatcctggctgttaaggcaatcatttttcagactggacccagctctcatcctgatcaggagccctatatccttacgtggcaagatttggcagaagatcctccgccatgggttaaaccatggctaaataaaccaagaaagccaggtccccgaatcctggctcttggagagaaaaacaaacactcggccgaaaaagtcgagccctctcctcgtatctaccccgagatcgaggagccgccgacttggccggaaccccaacctgttcccccacccccttatccagcacagggtgctgtgaggggaccctctgcccctcctggagctccggtggtggagggacctgctgccgggactcggagccggagaggcgccaccccggagcggacagacgagatcgcgatattaccgctgcgcacctatggccctcccatgccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaatttggctaaggtaagagaggtgatgcagggaccgaacgaacctccctcggtatttcttgagaggctcatggaagccttcaggcggttcaccccttttgatcctacctcggaggcccagaaagcctcagtggccctggccttcattgggcagtcggctctggatatcagaaagaaacttcagagactggaagggttacaggaggctgagttacgtgatctagtgagagaggcagagaaggtgtattacagaagggagacagaagaggagaaggaacagagaaaagaaaaggagagagaagaaagggaggaaagacgtgatagacggcaagagaagaatttgactaagatcttggccgcagtggttgaagggaagagcagcagggagagagagagagattttaggaaaattaggtcaggccctagacagtcagggaacctgggcaataggaccccactcgacaaggaccagtgtgcgtattgtaaagaaaaaggacactgggcaaggaactgccccaagaagggaaacaaaggaccgaaggtcctagctctagaagaagataaagattaggggagacggggttcggaccccctccccgagcccagggtaactttgaaggtggaggggcaaccagttgagttcctggttgataccggagcggagcattcagtgctgctacaaccattaggaaaactaaaagaaaaaaaatcctgggtgatgggtgccacagggcaacggcagtatccatggactacccgaagaaccgttgacttggcagtgggacgggtaacccactcgtttctggtcatccctgagtgcccagtaccccttctaggtagagacttactgaccaagatgggagctcaaatttcttttgaacaaggaagaccagaagtgtctgtgaataacaaacccatcactgtgttgaccctccaattagatgatgaatatcgactatattctccccaagtaaagcctgatcaagatatacagtcctggttggagcagtttccccaagcctgggcagaaaccgcagggatgggtttggcaaagcaagttcccccacaggttattcaactgaaggccagtgctacaccagtatcagtcagacagtaccccttgagtagagaggctcgagaaggaatttggccgcatgttcaaagattaatccaacagggcatcctagttcctgtccaatccccttggaatactcccctgctaccggttaggaagcctgggaccaatgattatcgaccagtacaggacttgagagaggtcaataaaagggtgcaggacatacacccaacggtcccgaacccttataacctcttgagcgccctcccgcctgaacggaactggtacacagtattggacttaaaagatgccttcttctgcctgagattacaccccactagccaaccgctttttgccttcgaatggagagatccaggtacgggaagaaccgggcagctcacctggacccgactgccccaagggttcaagaactccccgaccatctttgacgaagccctacacagggacctggccaacttcaggatccaacaccctcaggtgaccctcctccagtacgtggatgacctgcttctggcgggagccaccaaacaggactgcttagaaggtacgaaggcactactgctggaattgtctgacctaggctacagagcctctgctaagaaggcccagatttgcaggagagaggtaacatacttggggtacagtttgcggggcgggcagcgatggctgacggaggcacggaagaaaactgtagtccagataccggccccaaccacagccaaacaagtgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccgaggagttttaacccaaaccctaggaccatggaggagacctgttgcctacctgtcaaagaagcttgatcctgtagccagtggttggcccgtatgcctgaaggctatcgcagctgtggccatactggtcaaggacgctgacaaattgactttgggacagaatataactgtaatagccccccatgcattggagaacatcgttcggcagcccccagaccgatggatgaccaacgcccgcatgacccactatcaaagcctgcttctcacagagagggtcactttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaggatggctggggcggcggtggtggacgggacccacacgatctgggccagcagcctgccggaaggaacttcagcgcaaaaggctgagctcatggccctcacgcaagctttgcggctggccgaagggaaatccataaacatttatacggacagcaggtatgcctttgcgactgcacacgtacacggggccatctataaacaaagggggttgcttacctcagcagggagggaaataaagaacaaagaggaaattctaagcctattagaagccttacatttgccaaaaaggctagctattatacactgtcctggacatcagaaagccaaagatctcatatctagagggaaccagatggctgaccgggttgccaagcaggcagcccaggctgttaaccttctgcctataatagaaacgcccaaagccccagaacccagacgacagtacaccctagaagactggcaagagataaaaaagatagaccagttctctgagactccggaggggacctgctatacctcatatgggaaggaaatcctgccccacaaagaagggttagaatatgtccaacagatacatcgtctcacccacctaggaactaaacacctgcagcagttggtcagaacatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaaaaaaatactggaggaaatttttccgagatttggaatacctaaggtaatcgggtcagacaatggtccagcttttgttgcccaggtaagtcagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccctatgaattgctctacgggggaccccccccgttggtagaaattgcttctgtacatagtgctgatgtgctgctttcccagcctttgttctctaggctcaaggcgctcgagtgggtgaggcaacgagcgtggaagcagctccgggaggcctactcaggagaaggagacttgcaagttccacatcgcttccaagtgggagattcagtctatgttagacgccaccgtgcaggaaacctcgagactcggtggaagggcccttatctcgtacttttgaccacaccaacggctgtgaaagtcgaaggaatctccacctggatccatgcatcccacgttaagctggcgccacctcccgactcggggtggagagccgaaaagactgagaatccccttaagcttcgcctccatcgcctggttccttactctaacaataactccccaggccagtagtaaacgccttatagacagctcgaacccccatagacctttatcccttacctggctgattattgaccctgatacgggtgtcactgtaaatagcactcgaggtgttgctcctagaggcacctggtggcctgaactgcatttctgcctccgattgattaaccccgctgttaaaagcacacctcccaacctagtccgtagttatgggttctattgctgcccaggcacagagaaagagaaatactgtgggggttctggggaatccttctgtaggagatggagctgcgtcacctccaacgatggagactggaaatggccgatctctctccaggaccgggtaaaattctcctttgtcaattccggcccgggcaagtacaaagtgatgaaactatataaagataagagctgctccccatcagacttagattatctaaagataagtttcactgaaaaaggaaaacaggaaaatattcaaaagtggataaatggtatgagctggggaatagttttttataaatatggcgggggagcagggtccactttaaccattcgccttaggatagagacggggacagaaccccctgtggcagtgggacccgataaagtactggctgaacaggggccccctggagccaccgcataacttgccggtgccccaattaacctcgctgcggcctgacataacacagccgcctagcaacggtaccactggattgattcctaccaacacgcctagaaactccccaggtgttcctgttaagacaggacagagactcttcagtctcatccagggagctttccaagccatcaactccaccgaccctgatgccacttcttcttgttggctttgtctatcctcagggcctccttattatgaggggatggctaaagaaggaaaattcaatgtgaccaagagcatagaaatcaatgtacatgggggtcccgaaataagcttaccctcactgaagtttccgggaaggggacatgcataggaaaagctcccccatcccaccaacacctttgctatagtactgtggtttatgagcaggcctcagaaaatcagtatttagtacctggttataacaggtggtgggcatgcaatactgggttaaccccctgtgtttccacctcagtcttcaaccaatccaaagatttctgtgtcatggtccaaatcgtcccccgagtgtactaccatcctgaggaagtggtccttgatgaatatgactatcggtataaccgaccaaaaagagaacccgtatcccttaccctagctgtaatgctcggattagggacggccgttggcgtaggaacagggacagctgccctgatcacaggaccacagcagctagagaaaggacttggtgagctacatgcggccatgacagaagatctccgagccttagaggagtctgttagcaacctagaagagtccctgacttctttgtctgaagtggttctacagaaccggaggggattagatctgctgtttctaagagaaggtgggttatgtgcagccttaaaagaagaatgttgcttctatgtagatcactcaggagccatcagagactccatgagcaagcttagagaaaggttagagaggcgtcgaagggaaagagaggctgaccaggggtggtttgaaggatggttcaacaggtctccttggatgaccaccctgctttctgctctgacgggacccctagtagtcctgctcctgttacttacagttgggccttgcttaattaataggtttgttgcctttgttagagaacgagtgagtgcagtccagatcatggtacttaggcaacagtaccaaggccttctgagccaaggagaaactgacctctagccttcccagttctaagattagaactattaacaagacaagaagtggggaatgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgaaagccctagtgacgtatctcaactgcaatctgtcactctgcccaggagcccgtgcagatgcggacctccggagctattttaaaatgattggtccacggagcgcgggctctcgatattttaaaatgattggtccacggagcgcgggctctcgatattttaaaatgattggtttgtgacgcacaggctttgttgtgaacccca

SEQ ID NO: 149 - DNA, 8224 bp, Artificial
  mm626 sequence
tggctgagctcaactggggctggggctggagacctgggttcttcacgtgggcctctctgcccgttagcttcctcatcgtaggaggaatgggcctcctctagacaggaagtgaattctaagaacaagcaccccatggacaggaaggaagctgttaggatcttaagatctgggtccagaaactggccctgtcaccgccaccaaattctgttgttcgagcaatcacaggacccaggttcaagtagaggggccataatgattttagatgggcaggttgtcaaagaatgaaggagcccagtttcaagcccaccacgatacttccctccacaccagcaccctgccccttcctaaactctgcctctgcttggcttcagcgtttagttcctttcctgaactgttgtcagcacctgtgagcttgactcctctattcaaacttttctccacttcttccccacagtgctattactaagactacatccttactcacctcttttaaaccctttgatggctccccattatccaaataatgtccatagagttcccattgtagctcagtggttaacgaacccaccagtatccatgaggacacgggttcgatccctggccttgctcagtggattaaggatccagtgttgccacgagctgtggtgtaggtcacagacacagcttggatcccacgttgctgtggctgtggttggtgtagacctgcaggtataggtccaattccattcagcctgggaaccaccatatgctgcaggtgctgccctaaaagacaacaaacaaaaaaatactgtccaaatgttttagcaaaatgccatggttcccaacctgtgtgcccaggtaccctgggagatcacaccaagctcgcagtggtacaggaggataactaacaacagcaagacgaacacagagacatccgttagatcctgcacaaaactgtagctcgaggtctttacccgtttcaagatggagctacgttcttttgaagacgccctttgcaaagtttgcttctggggattgctgggatttcaaaagcaaaagcaaaaacagaactatgtgaaaatcagtgtggaatatgaaatgaagagggtggtatccaaactgatgttacagtttgggatgttctcagtgaggagtaaacatgcacatctcataaattactattacagaatgataggaaaattacttttttgtttttgctttttagggttgtacctgcagcatatggaggttcccaggctaagggtcaaatcagagctaaagctgcaggcctgcaccacagccactgctcagtcacagatccgagccatgtctgcgacctacaccacagcttaccgcaatgccggatccttaacccactgagtgaggccagggattgaacccgccaccttatggttactagttggattcctttccactgtgccacaaagggaactcctgaaaattactttttcttttagcttacatgcattttttccccaagcagctattaagtcattggaacacaattacttaggaaattctttgggcctaattacttaataaacagaactgttaagtatttccttcattctaggattgctatgaaaaattctgagtcactaagaacaccaagaactgagaaagtttgagaactttacatgtaacattttatgggacagaaatttgagaaaagatatttaaaagctgatggccatcctttttttgggaaaacctctccccccatcaccagggtacctggtgaggaggaaagatgctgttttcttgagtttgtgggaattgtattactctgtctttgcccccagtgtccacccactggcccactttattcttccaaacccccagtctcataatgttcagtgctgtctgttcaggagtgtaggtttgccctcctcacctctttacatggaacgttctggaactttctccgtgatttgataactctcacatatccggactttcttcacagtctatttcctactctttaacccaaaccagtttcttccctgatgcctggcttatcctagcagtcttcttcgaagaaagcctttttattctttgtggtgagggatgttcccttacggattctctcagtgactaacttgcttcggaaagccagcccccccatcctgactttctgaacccctcctgctcccgtaaggctctccctgtcagcttaaccccctgccctccccccacctcctctcggccaccaagagcttctgtttctcgcccctcccctgtccgtcgatgacttggccctctggctcaacgtcctttcctccaccctgtctggtctccatcctgagtgacctcagagaccatgcgaatgagtcagtccccacccagacctctgatccctcagtctcctcatcgccaattacctgctcctgctccatgtccaccaaccagcatcacggccccgcccagactcctccaagtgtggtccagggactggtggctccaggatggtccaggagtcatgacaataggattccaaggccaactgtctagttctcctgaatcacagttttgggggaaaatcctgggaaactgcatcgctatcttcccaggtgattcttaggaagtaactttttttttttttttgagtttcaatttatgtatttatttttaccttaggagataccttggagatccactgcgctaaacgtgcggccccaccatttaataactcagagatctcattagctaacccgaatctcccatctttccaggtgattttctcaattatcgccactacaactgctctttatatagcgaggcctcgccctttgcgttctttctcacctgctatctcctgatttcacacccctctctctccagcttagatttgtattaatcatagtggcagcaaacttttcctgagcacttactgtatggcagacactgttctgactcctttatcacgttgatttgtttgagcctgagagcttggtgaggtcgtatccatgttcatcttcattttttttttcttgcccagattttctgttctcttgcccagattttctgccttctgagcttatatcaggcagcccctccacccaagatccgccctcctgtgctcgcatcctggcccctgagcacagcaggaaggactgggaccatctgaggtcaaggccacctgccctaatatttctggagtctgcacgttctctctgtgggttgggctatttcatgcctcccactgcagcatctcccttccttctagcgaacactttgattcctgctttactatcgaatggaaactctcagagaaatacaaacaaaactgctcgccctcaaatctacaaaaatgtcaatgtgcacacatgtgtttctttcatttattcacatatttaacagacagttattgggcattagcatatgacaggctctttgctgtatggtttcaaggaagatgtaggttcttttcctcttcttatttgacaatgggaaaattaacagagaggccaggaagcttgcctggttccagatctagtcagtggagaagccagccagactcagggtctgagcttcttgccagcaggtggtactgctgcccccacagtgaccaccccctcgccaggagtctggccaagggtgagatcagccaagggccttagttcgatgacagcagctacactgttacccatttgatatattggattgtatcaaagattcatttctttaaaaaaaaaaaatgagggagttcctgtcatggcacagcagaaacgaatccaactaggaaccatgaggttttgggttcggtccccggcctcgctcattgggttaaggatccggcattgccctgagctctggtgtaagttgcagatgtagctcggatctggcgttgctgttgctgtggccagcagctacagctccaattagaccccttgcctgggaatctccatatgtcgcgagtgtggccctaaaaaggacaaaaagaccaaaaaaaaaaaaaaacaaaaaacaaacaaaaaacatcaactaaaaaaaaaaaaatgataggaaggtcccctgcggtgcagtaggttaaggatcttgcattgccatagcagtggcataggttgcgactgcagtgcaggtttgatccctagcccaagaacctccacatgctgtgggtgtggccaaaaaataaataaaatttttttaatagtaaaaaaaattctttttcttagtgaagattgaggaaatactctacctcatgcctgttggtccctgtatgaaaagccacacatgatctgctttttctgaaactggaggttaggaacggcttggttcctgctgaagaatctctttgctttctcctctggatattgggaaccacagcattgatcacagaaacttttgctttgtcatcccagaagcttagggccaaattccaactcaataagaaccttgcttcttctctagttgtcttctttccttctgggccttaaccacctattccatttttaagcactgttcatccatatgttttaaatttggcatatgttttcgggatgttgcttcagatcctttttggagccagatttgatgccattagggagaatgtatgagaaacatttttaaaactataactgtaaatgtctaaacataaggagataaatgcaagtgttttagtctttacaaatgccttacagcccagctgtgcatttcagatgcggtgaactgaagtctaggggaactcaacggagccctgtaatcccatctagactctgggcaacactggaagagaagacctctatgcactaagggttcgttactcagcacttcaagaaatattgggattcctccttggtttggttatggtgagagcttgctacttttacagctcatttcatactgagattctggatgaaggcagcggagtaggaagatcccaagctcacctctaatgcacacaccaaaaggatgcctacacatagaacagctatttcttttttttttcttttctttttggccatttcttgggctgctcctatggcccatggaggttcccaggctaggggtcgaatcggagctgtagccaccagcctatgccagagccacagccacacaggatctgagccacgtctgcaacctacaccacagctcaccgcaacgctggatccttaacctgctgggcaaggccagggatcgaacccacaacctcatggttcctagtcggattcgttaaccactgagccatgacgggaactcctagaacagctatttctgaggacaatctgaggatacaaagaaaaaggcacatcaagggggggggggagagagaggtagagatgcaatagtcagacccaccccattgtagcgacctacaagtggtagggatgtcacaactgtggaggtccctccccgcccaccccaggagcctgggagacctgcactgggaagaggagcccccataacatctggctttgaaaaccagcagggattgtgcctgggagagatggaggactgtggaaaaccaagactctgctctcaaaagcttgtgcgcaaactccctccctccaagtcccagctcagaggcagcagcttaaagagcacctgggtcctacaaggagattcattatcagccataagaaagaatgaaatgatgtcatttgcagcaacgtggatggacctagagcttatcataccaagtgaagtaagtcagacagtcaaagacaaacatcctatgatatcggagttcctgtcatgggtcgctgttcaatgaacccgactagtatccatgaggatataggtttgatccctggcttcgctcaggggcttaaggatctggtgttgctgtgagctgtggtataggtagcatacatggctcagggctcagatctggtgttgctgtggctgtggtgtaggctggcggctacagctccaattccacatctagcctgggaaactccacatgccgcgggtgcagccctaaaaagacaaaagccaaaaaacaaaaaagaaaaaaaaaacccatatgatataattcatatgtggaatctaaaaaaaggatacaaatgaacttatttgtagaacataaatagactcacagactttgaaaaacttatggttaccaaaggggacaggttggggcgggggtggagagagggactggggatttggaactggcatatgcacactgtagtatatggaatgatggccaatgtggagctgctgtctagcacagaaaactctagccaatattctgtgatcatctatgtgggaaaagaacctgaaaaagaagggatgtgtatacatgcatggctgaatcactttttgtacagcagaaattatcacattgtaaatcaactgtaattcaataaaaattttaaaaatgcaaacaaggagaaggagatgcattgactcattttaggatgtgtgtcagaggggcaggggtctggtgaaacttccggtgaggatggaagcacgactgggcaccattgtatttttactctcctccctcccagctggctggtgggtgggtaccatttctgtcactctttatcaacccaggtaaccctgcaatgaggacccacccaccatggctggctctctaaagttgtggcaaaggaatctcatggtaactgcaaaccaaaaatctgtaacagatccacaaaaaacaaaaagaaaggaaaacaaagatgatactaaaatcatcacatcacaaggggagagatcaagagaagaatgttgcactatgaaacaaccagagaacaataaaatagaaagtgtagacctatcgaagaattactttcaatgtaaatggactaaatgctccaatcaaaagatattgggtgcctgaatagataaaaaaaacaaaacccgtgcataacctgcctacaagaggctcatttcagatctgaaggcacacagactgaaagtgaaggggtggagaaagctattccatgatgaagaaatgaaaagaaaccgggggcagctctgcttatatcagacaaaaaagaccttaaaacaaagactgcaacaaaagacaaaaagcgcgttacacaatgataaagggatcaatcaaacaagagaatataatatttataaatatacatgcacccaacataggggcacctaaacacataaagcaaacattaacagagataaagggagaaattgacaataatcccatcaaagtagggagcttttaactaaaaccttccctaacctggtgaaggaaagagagtccaagtccaggatctgctcctcaaacaagtgaaacaaaagcaaaaataaacagacttgactacttcaaactaaaaatcttctgcatagagaagaaaattatcaacaaaactaaaagtctgtctgctgaacaagagaagacatacaaatgatatatctgatgaggggttaatactaaaaatatacaaagaactcacacaactcagtatcaaaaaaaaacaaacaatttgattaacaatgggcagaagatccgaacagacatttttttcaagatatgcagatggccatgaaaagatgctcaacatcactactcatcagggaaatacaaatcaaaaccatagcgaggtatcacctcacagctgtcagaatggccatcattaaaaaaaatagcaaaaaaaaaaaaaaaaagactggcattctcgttgtggctcagtggttagcgaacccaactagtatccatgaagttgtgggttcgatccccagccttgctcagtgggttaaggatcgggcgttgccatgacctgtggtgtaggtcgcagatggggtttggatcccacattgctgtgcctgtggtgtaggccagcagcttcacctctgattagaccccctagcctgggaacctccaaatgatgctggtgcagccctaaaaaaaattaaaaataaattaaaaaaatagaaaaatagcaaataacaagtgttggcgaggatgtagaaaaatgggaacccttgtgcaatactggtgggaatgtaaattggtgtagccagtatggaagagtatggcggttcctcaaaaaataaaaaaatagaactaccacatgattctgctcttccacttctgggtgtatatgccagagaaagcaaaaacacgaagttgaaaagatgcattcaccccgacgctcagagcagcattatttacagtagccaagacatggaaccaacctaagtgtcaatcgacagatgaatggatagagaagctgtgttatatatacacatatatacacaatggaatactattcagccataaaaagaatgaaatctcaccatttgt

SEQ ID NO: 150 - DNA, 7577 bp, Artificial
  ss1224 sequence
atgggtaaatcagcttccaagcccactgtcttagaatgtatggctaagaatattaagaaaggattttctggaaattatggtgttgaatggggtcctggaaaactgtgtactctctgtattctagagtggccctcctttggtgtcggatggcctccgtgagggaccgtagatgtgcccacagttcaagccataaataatattataacaggagaccctggacacgcaaaccaattcccatacattgatcaatggttagaagttgcccagttgaggcccccatgggtttggttctgcgtcacaggccagaggcagtgtaaggtgatagtagcccagtccaagaagaaaatcttgccttgagaaaagaagccacctatttttcaaggggatgccaaggactcgccccttgagccacctctgtatgtgcggccagcccctcctttgggggctgaaggtccccagtggccagatagcaccgccttctgtttctcctccttctcctcctcctcctcctcctgaagtccccaaggccatatgactgccacagccagattcaccggaaccagtgagcaggtgtctctggtcagcccagggagcagctccagaactgcaaatgccctatgggagacacagggaccgcagcaaatcacccccaatggaaccattcaagaggggggcagggaccagtcttttactaccagcgcttttccatgacagacctcctcaactgaaaacaccaaactccctcatcttctgaaaagcctcaggtgctgatcagcctcttagaatccattttccagacacatcatcccacctggctaggctgtcggaagctcctacttgctttgtttaagaccaaagagctgcgagaaagtgtaacagaagcccagaaatgccttcagaccaatgtcccaggggatctactacatgtggaaaactgggcaagggaagccttcccagaggaagaacccccctgagaccacacacaacactgaagggggaagatataatttagaaaggtactggcaggccctcctacaaggggtaaaaaaaagcctactagcatggctaagaccactgagatattacaaaagcccgatgaaagcccagccaacttctatgagagactatgtgaggcttatcgagtctacacccccttttagatcccgaggcccctgagaaccagcaggtgataaatgctgcctttgtgggacaagcccaatcaggtagccataaaaagctacagaaactagaaggatttgcaggaaaaaaaatgccactgaatttgttagaaataggtttttgttaactgagatcaggtggcctgctgcaatgcagaaaagagaatgaaacaaaaagtgacacatctggggccgctctctcataactgtttcccccagtgggaccaccccgtaaggcacgggacccaaggccaggaaaaaggagcccccagcccatgatcagtgtgcttactgcacaaatgaatgccccaacctccctgagacaaggaccaaagcagcacccctacctagccggtaccaatctgagccatccagcacaaatctgatccacctagccaagtccaattaggggggacagggctctctccaactggggcctgagagcccatggtcagaattcaaatagggggccaccctgtagactttacagtagacacaggtgccgagcattcagtggtcacacaacctgtagctcccctcttggggaaagaaccacgatcgttggggccacaggtgaccaaagctgcaggcccttctgtggtccccagtggtgccagttaggaggccatgaagtaatacacgaatttctttacctccctgactgcccagtccccttgatgggaagagacctgctggctaaaatgggggcacaaatttccttttccgctgatggatcagccaaactcaaatgagcagaatccccatctcctttaatcaagtcccttgctgtaagaagggaagaggaccgtcccctgtactcctccccttcagaaatggggaccatttcccccagaactagagatcgagtgcccattggtttgggctgaagggaaccctccaggactggcaaaatgcgacacccctatcttgattgatctgaaacccagagctcaaccagaaaagctgtggcagtccttgattccctgagaagctcgactgggaatctaggctcatctgaacaggttactacagatcagactgttgataaagtgtcagtcaccctggaacatccccactgcctgtaagaaaactgggaacacaagactaccacctggttcaggacttgagagccataaatgaagcaacagtcacgttacacctgtccatccctaacctgtatacgctgctggggctgatccctttcactgctgagtggttcactggcctggactttaaagatgccttcttctgcctctgagtggcccctgctagtcagcccttatgtgcctttgaatgggaaagtccacacacagggacaaaggaacagctcacctggactctcacaaggattcaagaattctcacgctgttttcagcggtgccctagctgctgacctggctgaattttctggacaaaaactggactgtgttttgccacagtacattgatgacctagcaccacgctagctagcaccatgcaggctcagtgtttagaaggaacaagagctctcctctccctactaatggaggcagggtattgggtatcgaagaaaaaggcacaaatctgtaagaaatgagttaagtgtctgggctttaacattatgcagggctgacagatgttggggcaccgaacgaaaacagatagtttgcaccattcctcttcctaccacctgccgggagattcgtgagctcctagagcagcaggattctgccagatatggatctctgggttttcagacttggccagacatctgtatgaggctttaaaaggggaagaaaaggctccccttgaatggggaccaagccaggaggcagcatttcaggcaatcaaaaccaaactcaatgaggctccagctttaggacttcttgatgtaaccagagaatttaacctctttgttcatgagaaaaatgggatggctttgggagtcctaacccaaagttcgggccttggcagaggccagaagcatatctgtctaagcaaatcgactcagttgtggctggatggcctccctgcctccaagcgctagcagctaccaccttgttggtaagagaggctgacaagttgacttggggacaaaacctcaagtcctgcattcagttgtaaccctaatggacactaggggccaccactggctcatgcatgcacacatgactcaggaaaacccctgggtaaaactggaggttgtatgaactctgaacccagccacttttctgccagatgaagtggggcccccatatcataactgtttagaggtcctagatgaggtgttttccagcaggcctgacttgcctgataaactactccagaacccaggggttcctgttgtggcgcagtggttaacgaatctgactaggaaccatgaggttgcgggtttggtccctggccttgctcagtgggttaaggacccggcattgctgtgagctgtggtgtaagttgcagacgcagttcagatcctatgttgctgtggctctggtgtaggccagcagctatggctccgattagacccctggcctgggaacctccatatgccatgggagcagccctagaaaagtcaaaaagaccaaaaaaaccactccaaaatccagacctggttttatatatactgatggcagcagcttcatggaggatagaaaaaagatggcaggttatgctctggtgtctgacttagaagtgatggaaacagaggtgcttcctcaaggttggtcagcacagagagcagaattatgggccttaatcagggtgctagaattcagccagtgagttaatatccatactgatcacagtatgcctttgcaactctgcatgtccatggagccttatataaggaaataggatgcctaactgctgaaggaaaatggatcaataaccaagctgaaatcttaaagctcctacaggcagtatgggagcctaaagaagtggcagtttccactgcaaaggccaccaaaatgagggtgacccagtggcaaaaggaaaccgcagtgctgacacagctgccagacaagcagtccgaggacaaccatcagacaaacctaaggtcttgctggccccagaagtgccagctgtccccaaatattctccagaggaagaaaaatggatgagggaggaaggaggaaccaaaactaaaacagagtggtgggtcacacaagaccaccaggtttatgttccagaacaactggcctacaaactagcccaccagcaacaagagttaacccacacgggcaaaactgctttggagaccttactgggccagtattatctcattgcatatcttcccacactctgctccaccatcttcccctggtgcataacttatttgcaaaataatgttcaccaggggcctagcagaccagccaggacacacacaaccatttgaagatatggaagtggacctcactgaagtcatcccaagcaagggatccaaatacttggtatttttttttatttgcactttttcaggttgggtagaagccttccccatccaaactgaaaaggtaaggaagtcaccgaggcactcctgagagacatcactgccagatacggaatgcctctgagcatcgggtcagacaatggaccagcatttgtggccaaggcagtgcagcaggtggcaaaagccttacagatccggtggaagttacactctgcctattgcccttaaagttcaagcaaagtagaacacatgacctgaacccttaaacagacactggcaatgttatgtcaggagactggcttgctctgggtagacaggttgccggtggccctcttacaagtgagatgctcaccccgagcaggaataggagtcttgccatttgaaatcttatatgggaggccgtctccactgatcagtttgagaggaaacaccagagagttgggagacttggaattacataaacaatgacagggattgggggggtcactatctcacaaatacatagatgggtcacagatagaatacctgtgtctttaggcataacagcgcatccccacaagctgggggaccaagtatgaatagaggactggaaaaaaaaagaggctttaaggccaatatgggaaggcccctgtattgtaattctaaccacccccactgctctcaaattaacaggaatagaggcttggatccatcattccagaattcaacaggctggcccagatcatgactgaggggaatgagaaactgcccttgatccagagagaccactacacctgtcaatacagaggaggagacaaagatctcaaagccctgttctgaccataccagaagccagtcagtcaacgcatggctgaagcttgaagaatcagatgcatggtcaaatagactgccttatttcccataagagcctgccttactgtcatatcctgttatcctatacccaacatgtaaggttgctgtttgctcttattaatctggtcccccttggccctgccaggatccatttccccatgcgacccatgcaattcaagtgacccgatcagatcagggtgttacatggactttgcttttctccactcgtttctcctgtttgggagaaattcaaggacgttgtacccacaaccaaaccacttattccctctgtcagcaggggaacaaatacacttcctttgatccacaatactcaccaactgaggtatggttggaggtccggtgctctcataaaacagggcatctgattaagcggacccaaattaccaaggctgagttgccagtatcagtaccctttgatgcctgtgaagctatgacaggtcatggacttctaccatacccatgtgggagcccatcatgaaaaagagactataggctccaagataaacatatgtgctgggggacccctggagcggtgccaggagtgcacttactgcagctgcgtaacctgagcaacctgggatgagggagacagaacagctgtccttcaaaagggcacagcccctccagactaaggcttacaacccagttaatttcactctttacaattccaaggagcccaagtggaaggagggtctcataactgacatacgcattaacagaggaggcattgaccctggagctctgttacagttccagaaggtcaggcagacgcctcaagctgcctctcacagggtcttccattccttttatgaagagataaagaacaccccacctcccatttgggccacttgtttttggccctggcagaaacgattgcacaaaccctcaaggtctcatcttgttatgtatgtgggggaccgaacgaagaagaccactggccttggcaagccagggaactgaagcagttagagccccacaatgagactgcataccctcaatgcgccagtgggttatggctcctcaaaactgccattataggggaaaactctcttgcatggtggggaggatggttcaatgtatcagttagaagcctaacatgtttaggcctaaggttttataatctgactgccccaaagacctaaaagtggtcatccatcaacctctcggagcccaagcctaaccctctatctaacttttctcacctctgacaggcatgggacaatatctgtgcagatatccaatggcgagcaccaaagggattatgttggatttgtgggaaaatggcatattccatactccccccagcccccagtagcgccggggcatgtgtcctggggacaatcagactgtccttctttctgatcccactgtcattaggggaacaactgggagtccctatatataggacacagggtgcccagagagactggagggctctccagcctggaagggtgatgaatggcccccagaatggataattcaatatcatgggcctgccacttgggcagaagatggctcttggggatatcacccccccatctatatgctgaaccgcatcatcagacatcaggtggtgttggcacttataacaaacgacactgcaagggtcctgactctaccagcccagcagcaaactaaaaagcataatgccatctgccaaaactgcttgacctgggattatttgcttacttctggaggaggggtttgtggaaagtttaccctgagtaattgttgtctatgaatagatgacacaggaaaggtgatagaagaaattgctgatcgcatgactaaaatggcacatgtgcctttactgacttggaagggatgggacacagaaagtcttttcgatggatggttctcctggctggaggaattaaggcagtggttggaataatcatggtcatactcgtggggtgccgacttattccctgccttatacctctcctgataaatgttagaaaaggtttgatggaaaccatggttgaaagaaaaacagcctcccacctgctactcatccaaggttaccaactggtactgacagatgatggtttccaatgggaacaggtgcaccctgaccatcaagaagggggaatgaagtg

SEQ ID NO: 151 - DNA, 6825 bp, artificial
  ss1244 sequence
tcactcattattagagagatgcgaatcaaagccacgatgaagtaccaccttacaccagccagaatggccatcattcaaaagtctacaaataataagtgctggagagggtgtggaggaaaaggaaccctagtacactgttggtgggattggaaattggtgcaaccactgtggaaagcagtatggagattcctcagaaaactaaacatagaactgccatttgatccagcaatcccacttctgggcatctatccagagaaaaccaggactcgcaaagacgcgtgtactccaatgttcattgcagcactatttacaatagccaagacatggaaacaacttcaatgtccatcaacagaggagtggatcaagaagatgtggtacatatacacaatggaatattactcagccattaaaaagaatgaaataccagcatttttaccaacatggatggacctagaaactatcatgctaagtgaagtcagccatacaatgagacaccaacatcaaacgctttcactgacatgtgaaatctgaaaaaaggacagatggaacttttttgcagaacagatgctgactcacagacattgaaaaacttatggtctccggaggagacagtttggggggtggggggctgtgcttgcgctgtgggatggaaatcctgtgaaatcagattgttatgatcattatacaactacagatgtgataaattcatttaataaaaaaaaatgaagaaaaaaaaagaaattagaaggatttgcaggaaagaatgctactgaactgttggaaatagccaacaaggtttttattaaccgagaccaggtggccccccatgatgcagaaaagagaatgaaacaagaggtgactcttctggcggccaccctgtcaaaaccggtgcccccagtgggaccaccccgtaggggacaaggcccaagaccagggaaaaggagtcccctggaacatgaccaatgcgcttactgcaaagaaaagggacattggaaaaatgaatgccccaaccgtcctgaagaaaagaccaaggccccacctggccagtacagatctgagtcattcagcaccaacctgattggcctagctgagtctgattggggggaccaggctctctccaactgggcccccgagagcctatggtcaaaattcaagtagggggccaccccatagactttatggttgacacaggtgccgaactttctgtggttacacaacctgtagctcccctctcggggaaagaaaccaccatcgttggggccacaggtaaccaaacccacaggcccttctgtggtcctcaacgatgtcgattaggaggccatgaagtaatacattaatttctttacctgcctgactgcccagtccccctgacaggaagagacccgctggctaaaatgggggcacaaatttccttttctatggatggatcggcccaactcaaattgacagaatccctctcctttaatcatggctcttgctgtaaaaagggaagaggaatggcgcttgtactcttccccttcagagatggggaccattcccccagaactagagactaaatacccattggtttgggctaaaggaaacccaccaggactggcaaaacgccatgctcctgtcttaattgatctaaaacctggagctcaaccagtaaagctacagcaatactcaattcccagagaagctcaactgggaatccaggttcacctggataggctgcttcagcacggactgttaataaaatgtcagtccccttggaacacccctttactgcccataaaaaaaccaggaacacaggactactgctcagttcaggacttaagagccataaatgaaacaacagtcacattacacccgtccgtccctaacccgtatactgttagagctgatcccctccactgctgagtggtttacttgcctggacttaaaagacgcctttttctgcctctgggtggcgcccgccagtcagcccttgtttgcttttgagtgggaaaacccacatacagggacaaaggaacagctcacctggactagactcccacaaggattcaaaaactctcccactctttttagcggcaccctagctgctgacctggctgaatttcctggacaaaaactgggctgtgttttgctacagtatgttgatgacctcttactagctggtaccacggaggctcaatgcctagagggaacaagagctctcctttccctactgatggaggcagggcatcaggtatcaaagaaaaacgcacaaatctgtaaaaaaacaagtatctgggctttaacatcatgcagggccaacgaatgctggggaccaaaagaaagcagggagtttgtgccattcctgtccctaccacccgccggaaggttcgtgagttcctaggggcagcaggattctgccagatgtggatccccgggttttcagacttggccaggcctcagtatgaggctctaaaagaagaaaaaaaggctccccttgaatgaagagcaagccaggaggcagcatttcagacaatcaaaaccaaactcattgaggctccagccttgggacttcctgatataaccagaaaatttaacctttttgttcatgagaaaaatgggatggctttgggagtcttaactcaaaaatttgggccttggcagaggccagtggcatatctgcctaaacaaattgactcagttgcggccggatggcctccctgtctccgagcgctggcagctaccaccttgttggtgaaagaggctgacaagttgactctgggataaaacctcaaggttaaagtcccacactcagttgtaaccctgatggataccaggggccaccaccggctcacacatgcacaaatgacccagtctcaagggttactatgtgaaaatccatgggtaaaactggaggttgtacaaactctgaacccagccacttttctgccagatgaagcggggcccccagaccataactgcctggaggtactagatgaggtgttttccagcaggcctgacttgactgataaaccactccaaaaccctgacctgattttatatactgatggcagcagctttatggaggatggaaaaagaatggcaggatacgctgtggtatctgacttaaaagtgatagaagcagaggtgcttcctcaaggctggtaagcacagagagcagaattatgggccttaatcagagcactggagctcagccaagaccagcaagttaatatctacaccaactcacggtatgcctttgcaactttgcatgttcatgaagccttatataaagaaagaggactcctcactgctaaagaaaaagggattaaaaaccaggctgaaatcttaaagctcctagaggcagtatgggaacctaaagcagttacagttatccactgtaaaggccaccaaaaggagagacgacccagtgacaaaaggaaaccatagtgctgatgcagctgccagacaggcagcccagggacaacggccagacaaacctaaggtcttgctggccccagaagtgccagcagtccccagatattctccagaggaagaaaaatggataagggaggaaggaggaactaaaactaagacgggatggtgggtcacacgggaccaccgagtttatgttccagaacagctggcctacaaactagcccaccaacaacacgagctaacccacatgggcaaaactgccttagagaccctactgggccactactatctcattgctcatcctcctgcaccctgttcctctgtctcccaaagatgcataacctgtttgcagaataatgcccgccaggggccccacagaccagctggggcacaacactgtggactgtccccatttgaggatatggaagtggacttcactgaggtcacccctagtaagaggtacaaatatttactagtttttatctgtactttttcaggatgggtagaagccttccctacccgaactgaaaaggcaagggaagtaaccaaggcactcctgagagacattattcccagatatggaatgcctctgaccatcgggccagataacagaccggcatttgtggctgaaacagtacaacaggtggcaaaagctttacacatctgatggaaaccacattctgcttatcgccctcaaagttcagggaaagtagaacacatgaaccggacccttacagacactggcaaagttatgtcaggaaaccggcttgccctgggtagacatgttgccagtggtcctcctaaaagtgagatgttcaccctgagcgggaataggattcttgccatttgaaatcttatatgggaggccacctccactactcagtttaaaaggaaacaccaggaagttgggagacttggaattacctaaacaattacaaggactgggactcactatttctcagatacataaatgggtcacagacaaaatacctgtgtccttaggtataccagttcacccccacaagccgggggaccaggtgtggaaaaaggagcctttgaggccggtatgtaagggcccctatactgtaattctaactacccccactgctcttaaagtaacaggaatagacgcttggatccatcattccagagttaaaccggctagcgtacctgatgaccgtggagagtgggagactgccctcgatccggagagacctcttcacctgacaatacagaggaggagatgaagatctcaaagccctgctctgaccacaccagaaactggtcagtcaacgcacagctgaagcttgagaaatccgctgcctggtaaaataaactgccttacctaccttccacaagagactttcttactgttacatactgttgtcttatgaccaacatgtatgtttgctgcctgttgctgttaatctggtcccctttggttctgccaggatccatttcctcatgtgacccatgcattccagtgacccgatcagatcaaggggttacatggactttgctttactccactcatttctcctgttccagagaaattcacgaaagttgtactcacaacaggaccacttattctatctgtcaatggggggaaccaatatacttactttgatccacgatactcaccaactgagtaatggttagaagtccggcgctctcataaatcagggcagctaataaatcagacccacaataccgaccccaagttaccagtttcaatactttttgatgcctgtgaagctatgaatgggtcatggacttctactagaccatgtggaagcccatcatgggaaagagaatataggctccagcataaatatatgtgctgggggaccacctggagcagttgccaggaatgcacttcctggagctgcgtggcctgggcaacctggaataagggagacaaaacagctttcaaaagggtatagcccctccagactgtcagactaaagcccaattaatttcactattttcaattccagtgaacccaaatggaaggagggtttcaaaataagcattcacattgacggaagaggccttgaccctggagctgtgctacatttccagagaatcacgtttgccctcttgcgctccaagctgcctctcacagggtctttcattccttttatgaagagataagaaacaccccacctcccattccagccacaactaagaacttgttcttagccctggcagaaactactgcacaaactctcaaggtctcctcttgctatgtacgcaggggaacgaacacaggagaccactggccttggccagccagagaactggacccattagagcctcataatgagactgcataccccaactcaccaatggggtatggctcctcagaactgctattatagggagaaattgtcttgcgaggcggggaggacggtttaatgtttcagttggaagcctaacatgtttaggcctaaggtattataatctgactgcccagaagactcagtggtggtcatcctccaaccgctcagagcccacctccgacaggcatgagaagatatcagtgctaatatccagtggcgggcaccaaagggatcatatattggatttatggaaaaaacagcctattccatactccccccgaattgggctggggcatgtgtactggaaaccatcagaccttccttcttcctgctcccactatcactagggcagcaactgggagttcctatatatatagggcacagggtgcccagagagactggatggctctccaaattggagactggaaagatgatgaatggcccctggaacggataattcaatattttgggcctgccacctgggcagaggatggctcttgggaatatcgcacccctatctatatgctgaaccacatcatcagactacaggcggttttggaacttataacaaatgacactgcaagggccttgactatattggcccaacaacaaactaaaatgtacagtgcaatctaccaaaatcacttggccttggattatttgcttctgaaggaggggtttgtggaaaatttaagtaattgctgtctacaaatagatgacaccagagaggtgatagaagaaattgctgactgcatgactaaacttgcccatgtgcctgtacaaacttggaaaggatgggatgcagacagtctctttggtaaatggttctcttggttgggaggaattaagacaatggtcggaataatcatggttatattcgcagggtgcctacttattccctgccttgtacctctcctgataaatattataaaaggttttataagaaccatggttgaaggaaaaacagcctcccacctgctatttatcagaggctaccaaagggttatgactgatgatgatctctaaagagtgcagatgcaccctgaacatcaagaggggggaatgaaat

SEQ ID NO: 152 - DNA, 7811 bp, artificial
  ss1248 sequence
tgcataaaccatgctattctatatgcagctgcactatgccctagaggcatgcaccagtgctaatagtttcctttgttactcactaagaggtagctttgtcattgcctatgcctgattttgctcactaacctacataggtcacgttccttaataaatggcatgtgggctaaagcctaggcacctttgttctgtggaagagagtgcctcctggtcccccactttctaaatgtaagactctttcaggatctcctgttgccctgcagctctggatgtggcagagtggggcccaacgtggggctggaagaggtctgctatgagcagagaaagtgaaactacagataacagatggtagccttgtaggagacagtagccttgcactcggcagagttgcaatggtgagtaggcaagtagaaaaaaccaagataacaatggggccgaatcaatcataggaaactaaacattgtattcagttgcttaaatgtatgttgaaacagtcaggggctgaggtaatagagtctatctaagatagaggaattgttagaagccattatcaaatataacccttgtttaccaggcaagggtactgtagactcagaatgttgggatctcatgggagaaaatttaaagtgtgcccatcatctgggacctctctttctgtttctgtttttttctacatgggaactagtaagacatgttttggaactcttgcgggagcataaagaaaagcctatgccttctgctcccctgcagactaatccctttcttgatgccagtttaaataagactttagctgtggaggcaacaccaagtccctttcaatcagccttaaaatctgctagtctagaggattggacctttttagcatcccctataattattgcccccgatcctcaagtcccaggacaaaatatccacacccataacccttttgattttaaagctcttaaagctcttcgggatagtgtaatacagaatggagttaaagctccctttgctatgagtctggtagaaagcatggggacactgcagcttcccctatgggattggcatatgatagccaaagccaccctagatggcagagactatttaattttggaagtctagtcttttcagatttttgtcaggagcaggctcacttaaatcaaagaaataaagttccaattacttttgaaatgtttcttgatgtagcaaaccagttgacttatgatcctcgagcgtatgagcagttgagcctgggaacccaaagagcatggatgacaatttctgagaggaaatccacaaggatcttttgtacaatggcttcaaggccctgcaaaaccttaccaacaatttgtggactgcctaactcaggtggtacatcatcaaatagcacattctcaggcagctgatattttaattaaacaattcacatatgaaaatgcaaataaagactgtaaaaggttagtggcccctgtaagaaattcgggaggcatctctgattttattaaggtgtgtcaagatgtagggagtacaggtcatattcaagcaatgcttgctgcagcattgaaagaacacttggcagctcaggaaagaaatgctttacctgtggaaaggcaagatgctttcagaaggaatgctgagcccactcaaaagaaaaggcaccccctgcaacaggatcatctccaagacctagtcataaccctggtttctgtcctcgttgtcagaaaggaaatcattgggctaatcaatgtcgatctaagtgtcaccaaaatggcactgtgcttacagcttctggtgttgggaaacaggaagccgtggccctgtcaaccaaggagggcatttgtggctcaaactgaaggggaatccaatcccttacaagggccactcttggcagcacaggatggacttaccctgcgccacagcagcagttttaacatacaaacagagcattcaggctatccctactggaatttatggccctcttcctcctgatacagtaggcctcattacagggagaagtggcttaaccatgaaaggcttataagttttgcctgcagtaattgatgcagactatcagggagaaatgaagatgataggaaggtcacataccattcatagtatacagccaggaatgagaactgctcaattgtttctgctgccctatcttaagataggaaagagttaccagagagaaaggggaacatcaggatttggaagttcagggacttctcaggtcttttggactcaggaagtcacaacggaatgtccacaaatgactactgaggttaatgaaaaaaatataaggggattaacagatactggagctgatgtttcggtggtttgttatagtgattggcctcccgcatggcctttaattacccccgaaatgaagttgaggggattaggagttctgactacagtccatcaaagtcagcagatgctttcctgggtcggaccagaaggaaaaatgggttattttaaactttatgttgctgatatacccatcactttatggggaagagctcttctttctgctgtgagacttaaattaacaactgcggatgtctgttgtggcgattctaatgagtcttcccctgaatggaaattaacggaaaaattaggataccaaaaacaggtttaggaaaaaataatcaaggcataaaagaacctataaacttgcccattaagcttaataaacatggaataggatttgatgaggatttttcagaggggccattgaaaattatctgctagcccatgcagatcgtatacagtggatttaatgatgatccggtttgggtagatcaatggcccctaactcaggagaaattgactaaaatacatgagttaagagctcaggaattgcaagctggacacattgaggaaactaacagcccatggaatactcctatttttactcttcctaaaaaaatcaggtaaatggaggctagtacatgatttaagagaaattaataaaacagtgtacactgtgggagacttacaaccaggcttgccttctcctattgcaattcccttagatggggccttaactgttatagatttaaaagattgtttttttcaccataccattagcccttcaagataaatgtagatttgctttctctcttcctgctttaaataacaaagcatctatgaaacaatatcaatggaaagtattgccacagggcatgaaaaacagccctaccaggtgccaaaaatttgtggttcaagccttagctcctgttagacttaaatatcccaaggcatatattatccattacatggatgatattctcctctctgctccaaaagaacaagtttttcactttgtgctcgattaccaaagtctatcttaatgaaaaggggcttatgacagccccaggtaaaattcaaaaaacccctccatttcaatatttaggaactttgacagaaggctgtactatttggccacagaaaatgcaaatttggatttctgagtctctgataaaatgatacagagttccagatgaactcagtgatctctagatctgagaaaatgcagcaagagggaatattttcctggaccataacagactaggaagataggtggtccagagactcttggctactgttaataaggtccagtccagtaatagcacattgagctgcctatcggcgaaatctttgccagatctagaaatattcattcctagcaccatgggacgaaatggcctccccaaactatggttgaaattatgaccatggcagagccttgggaactgaagtttggtgtttgtcatcagcctctatgtggaataaaacatgagctactgcagctgccaacccgtagcacccccctgagcagagctccatgtggagaccaggagggaggcactctgtgctctaggaaaactgatagcacaggccttcaaatcatcagattttaggtaaggattttaatggacccagagtcttgcatcttctcatatttagaaaagcagaaatcattcacagtggcatctgcattggccattagaagaggcagagtggaatagctgtgggtcagacatccaaggtaatactaggaaatattatgggagtaattttagacaagtctttgtattgctgagaacttaaggtgtatgtgccctgtcagacttgaggccaccagctgtcctcaaagtggcatcagctggcagctgcacccatacattttgaaggtctcctctgataacagaaaagaggcagcatgtataatgaccaatatagctcctgctaattacatgccaataacacatcaaacattaaaaccaacttagataaaactacacgcctccttcaacagtagcggtgtcaacctatatcgcaaacctctatttaaccttatttttcttttcttcccatcctctatagtaggaatctaccatgtccagccacccagtattcattgctcctagccagcaggaagtagctacagacgagaggtctattgccccatcccatatttaaaaaaaaaaaaaagaggatggaatgatagcttcccaggaggatggagacagacccccgccccctgaatgtgaccattcaccttggaaacctgctgtggacatgggtacagcccagcacaagatctacatcctgtcccagaatgtgaagcatagattaaccaccgacaaggattcactgccctttgtcacgggacttgaccacctaccccttccttgtccttcccctcttgcctcttcatcattgttgtttgagaattcaaatatttcttttttcttttttttttttttttttgcttttgctttttaaggctgcaccagtagcgtatggaggttcccaggctaggggttgtagagtggcagccaccagcctacaccacagccacagcaatgacagatccaagccacatctgtgacctacaccacagctcatggcaacatcagatgcttaacccactgagcgaggtcagggatcaagcccgcaacctcatggttcctagtcagaactccccaaatatttcttttattcttcactctattcgtattttctctttttttattcttcactctattcgtattttctcttttttatgtggtctacagaatcatattggtccagagaaaccaaatgaacgccctgcaatcaaaatttactatgactgttgttatgcagcaaataaagaaaaagggggaggtgttggagaccaccgaactgctgaagacaaatatctgctgaggcagagttctcaagtacagtgtctccttcaaagacaagataagggagttatgcataaaccatactgttctatacttgcgctatgccctagaggcatgcaccagtgctaatagtttcctttgttactctctaagagctagctttgtcattgcctatgcttgattttgctcactaacctacgtaggtcaccttccttaataaaaggcatgtgggctaaagcctaggtgcctttgctctgcagaacagagtgcctcctggtcccacactttctaaatataagagtcttgtgtgttttgttctaccgcacagtccctctttcaggatctctcgttgccctggagtgctggatgaggtaggtgaggatgtgggaaaaagagaatcctcatgctctgttggtgggaatgtaaattgccacagccactatggaaaacagcttggagattcctcaaataaatcaatagaacttctatatgatccaggaattccacttctgcaatttatctaaagaatacaaaacactaatttaaaaagataatattcagtcctatgctcattgtagattattcacagtagtcaagacttggaaacaataagtgtctacacacaacacaaaatggaatactcctcagccctaataaagaataaaatcttatcatttgtgacagcatggatggaccataaaagtattatgtcaaatgaaataagtcagaaagagatagacaaagagtatgattttactcatatgtggatctaaacaaagaaaaaagaaaacagtaaaaacctcataggtacagagaagagatgggtggttatgagaggggaagggggttggaggtgggagaaacaggtgaaggaggtcaattgtttggtggtagatggcaactagacctttggtagtgatcattctgcagtgtataaagatgttgagttcccgtcgtggctcagtggttaacaaatccgactaggaaccatgagattgcgggttcgatccctggccttgctcagtgggttaaggatccggcgttgctgtgagctgtggtgtaggtcgcaggtgcagcttggatcccacgttgctgtgactctggcataggctgggctacagctccgattagaaccctaacctgggaacctccatatgcctcaggtgtggacctagaaaaaggcaaaaagccaaaaaaaaaaaaaaaaaaaaaaaaaaaaaaaaagatgttgacttataatgttggacacctgaaacttatataatggtatatgactattttacttcaataaaaattcaagatagaatatgcagaagttagaggaaatagccaatgtcagaatttccagcttctgcaggagaaaaacaagatcatgagtgcagtgggtaggaatagcctgagaagaaacactgaaataccagagaggagatgtttatactgaagtggctgcaggtaagtttacaggtgtgacattagaagttgagttattttatgcctataacctccacttcctttttaatatagaagactagctcgcatgagtaatatccctacttatacacaaactcaatattcaaaatttcttagcttgataagatcatttcacatcaaaatatttaaaacagtaagagagatgcactccttattaaaagacaattaattatataaaggccttttccatggaagaattttattttggtttacaactttgctctaggaaatgctaagcatttttaaaattggagtcaatctataaaattgaatcttatcaaactaagcaaaagttctgaattgtttaagaatcatctaaacatggctatattaaaatggataaaaatatccacaatattcctcaatattagagtcagtctaaaatcttaggggtagcttgtttccatttatagttatctcaaaaactggcacattattagaaggaattcaaaacccaaaaaaaatgttaatatttaaaataccgttttggatagagaactcattgccatgggagtaaaaatggaaagataaccagaagagataaagccaaagggttgaaatgaaggggaaaatccttcagttaaaccactttcccaattttattttgatttctttttagctttcaaaagcagattaatatggaaaaaaaaaagaaaaacacaaagctggagaaaagagccacgatttttcttcttcagtgtcaaagaaacagctttccctgctcctactaaattggaactgagctcataaggttgaaaataaatgactcatttcttgggaaataaccttaagtgaaagattcttttggccccataattgcttttcttcaactcccattgacttaacctcattctcaaggcctcttctgctctctttatcccatcacactctgttggtatcaaatgtcccttaaaagtcggtctcctcacttgctatccatttggggaattttttttttttttctctcatgtaacctgggggcaggaataagtcaaaagtggccgtgctttctttctttcttttttgaaaatgtctctctgctgttgaagatctttaaaaacagaagctaaaaaaatataaccctgaaatttaacaaagtacattttactacctctgaaaaaaaaaaaaaaaaaaacgctg

SEQ ID NO: 153 - DNA, 5414 bp, artificial
  ss1254 sequence
gtaagagtgtgtggtaggcaaggttgataccacgcatcttgccacctcttatttcagccactctttccaatgttttgtatttcaacatgttcttcctgctcatagtgctcttcatcagggcttcatttgctctgtttatagaaatgattcctaattttagtagcattaccattgcagagtttattacttgaaaagttctctgtgttacacaacacagttcactgtgtgttgatgggtggtgatttccaacatatgaaaacaacatgttcataagtagtgaaatgccactcccacccctaaatcctaaaatcagcagcacctatgttattaaaatgtgtcctaggatgacagggagatgttcaagtcacaatgtatacacatggagctggcaggaagatgaaagtgcaaattggaaatctctgaaagctttgatgagttatcgctgggagccttggcaacattttacatttttaggaattagatttttatattctttgtgtgaaaacagtaagctctgaattgtctctctatcttctcaagaagggaactctctgttttctcagctgaattttttagtgaccacagtttgaaaagaattgatgttctcaatagctcttaggagatccatggaattgaccttttatttccccctttgcctgtaatctttaagagagctatcttaaaattaatgtgaaatgcagcggaaccacaaactgaaatctggtcacagttccacattacatgtgacatttaaggaggtaatcatcaatttaccatggcaacacaaggggcaatcagaaaatggacatttgaggagttccttttgtggatcagtgggttaagaacccaactagtatccatgaggatatgggttttatccctagtccccctctgagttaaggatccagtgttgccacaagctgaggcgtaggttgcagatgcagctcagatcccatatttctgtggcttgtggtataggccagaagctgcagctccaatttgacccacagcctgggaacttccatatgctgcaggtgcagccactacccgccccgcccccccaaaaaaagaaagaatagggacatttgaatggtgtaaagggttgaaagtgggcaactcaatatataagattttgacaattctaaacaatagctggtgcataaaataattttgagattaaaaatcaaaaaattctgactagtgtaaaacaaaaatagccaaagacaaatagcttacttcaaaacaatccaggtggttttagctcaaaggagcagctcacttggacaagactcccacaaggattcaagaactctcctcttttcagtggtgccccggctgctgacctggatgaatttcctggacaaaaactagactgtgtcttgctacagtatgttgatgacctcttgctggccagcaccacgcaggctcagtgcctagaggaaacaaaagccctcctttccctactaatggaagctgggtattgggtatctaggaaaaaggcaaaactctgtaagaaacaagtcaggtatctgggctttaacatcatgcgagaccgatcaatgtggagactgaaacaaagcacgcagtttgtgccattctggtccctaccacccatcagaaggttcatgagttcctaggggcagcgggattctgcaggatatagatccctgcgttttcagacttggccagacctctatatgaggccctgaaaggaggagaaaaggatcccctggaatggggaccgagccaggaggcagcatttcagacaatcaagaccaaacccactgaagctccggccttaggacttcccagtgtaaccagagaattcaacctctttgttcatgagaaacatggaatggccttgggagtccttacccaagaattcgggccttggcagaggccagtggcatatctgtctaagcaaattgactaaattgctgttggatggcctccctgcctccaagcactggcagctaccaccttgttagtaagggaggctgacaagttgactctaggacagaacctcagtgttcaagtcccgcattcagtcgtaaccctgatgagcaatcggggccaccactggctcatgcattcacaaatgacccaatatcaggggttactatgtgaaaatccacaggtgaagctggaagttgtacgaactctgaacccagctgcctttctaccagatgaagcagggcccctagaccataactgcttagaagtcctagatgaaatattttccagcaggcctgacttaatcgataaaccacttcaaaatccagactgggttttatataccgatggcagcagcttcatggaggatggaaaaaggacggcaggatatgctgtggtgtctgactcagaagtgatagaaacagaagtgtttcctcaaggttgttgagcacagagagcagaattatgggccttaatcagagcactagagctcagccgagaccagcgagttaatatctatagtgactcatgatatgcctttgcaactctacacatccacagagccttgtatgaggatcaaggactccttactcctgaaggaaaaggaatcaaaaaccaggctgacatcttaaagctcctagaagtggtatgggagcctaaagaagtggcagttatcccactgtaatgccaccaaaagggaggcaacctggtggcaaaaggaaacctcagcactgatacagccaccagacaagcagtccgggggcaactgccagacaaacccaaggtcctgctggccccagaagtgccgacagtccccaagtactctccagcagaagaaaaatggataagggaggaaggaggaaccaaaactaagacaggatggtgggtcacatgggaccaccggctttatgttccagaacagcggcctacaaactagtctaccaacaatacgagttaacccacatgggcaaaactgccttagagaccttactgggctggtactatctcattgcacatcttcctgcactctgctcctctgtctcccaacagtgcataatttgtttgcaaaataatgcttgccaagggcctagcagaccagctggaacacaacactggactgtccccatttgaggatatggaagtggacttcactgaagtcaccgtgagcaggagatacaaatacctgctagtttttgtctgcaccttttcaggatgggtagaagctttcccaacccaaactgaaaaggcaagagaagtaaccaaggcactcctgggagacatcattcccagatacgaaatgcctctgatgatcaggtcagacaacggactggcatttgtggctgagacagcgtagtaggtggcaaaagccttacctatccgatggaagctgcattcagccgattgccctcaaagctcagggaaagtagaatgcacgaaccaaacccttaagcagactctagtaaggtcatgtcaggagaccagtctgccctgggtagacatgttgccagtggccctcctaaaagtgagatgctccccctgagcggaaatgggattctccccatttgaaatcttatatgggaggccacctctgttgatcagtttgagaggaaacaccagagaactcggagacttagatttacataaacaactgcaaggattggggctatctcacaaatacacaaatgggtcacagatagaatacctgtgtctttagacataacagtacacccccacaaaccgggggaccaggtgtgaataaaggactggaaaaaggagcctttaaagccagtatggaaagggccctatactgtaatcttaaccacccccactgctctcaaagtaacaggaatagacacctgagtccatcactccagagttaaaccggctggcccaactgatgactggggaatgcagagctgcccttgatccagaggaacctctacacctgataatacagaggaggagagaatgatctcaaagccctgctctgaccacactggaagctggtcagtcaacgcacagccgaagcttgaggaatcggcggcccagtgatgtctgttggttgctgttattaacccggtcccccttgaccctgtcaggatccattcggaagggtgcacatgcaccctgaacgtcaagaggggggaatgaagtaagagtttaaactagagaaacaacccctcccaccccagctgaggaggcagctaaggtgcctgtcagcagcttttcttatcacataccacccttcttgtaaccttgtagcaacaacgtcccttatgtccttgctagcagccctgctaaccatgctccaagcattgttcatcagtttcacttttgtaatctcatttgctcagcttcttaggcaggaactgtgtctgctcacggaagggggagggccggcactgcttgccccagaaaaccttaagaccgggaagtctgtgttgtataaaatctacccagaacaaagacctggtgctcagactctggaggcgactcctctgagcctgcactggtgctgaataaacctggttattcggcatctccgagtgccgcttgtctcttcccactgccatggtttctgcaacagtataactgccctttacgtgtcttttacagatattttctccccgtctgtcttgtcttctcattcccttaacatcatgcgttgaagagcagaagtgtttaattttagtgaagttcagcttctctcttccatggattgtgcctttggtgttgtatctaataagtcatcatcatacttaaaatcatctggagtttttccaaggttatatccaacgagatttacagttttgttttttaagattatagttttgaactcttttgcattcagaaatgcatttacatagatgttattcctctgttgcttccttttaacttcttgcatcccagttttcttttgctttgggtaatggattaaggacagaagttgatgtggacatatgtggtattcccaacaccaaaataataatggaaccatgtttgttgttttgagggcagagaatggggccaagaccctttggccccaggcaatggaggctgcaacttgctgatgttaggggcatatttgggtgtatgaaaacaaaataactaaaggataagccaacttctggtcatgatttgggtgaaggaagcagagagaaaactcaaacggcaaatggaaccaaaaatgccgatctcttctgtggatgttagcaaaaagaaaaagatcaatttaaaagtggccaatctcagttctttcctgagccctagaaaaaggcttgagttttcaggggaagggaaactaataaaagctcaagggttgtagagggataagcaatttagtaaaacacaaatctggagtaggaaccaaatgagaagcaatgtcagatgtactgtgatcctggggcagaagtgataagtctcgggaaaagagatggtaagaagagagaagatgagaaaca

SEQ ID NO: 154 - DNA, 6403 bp, artificial
  ss1260 sequence
tggtgctcagactctggaggtgactcctctgagcccacaccagtgctgaataaaccttgcttttccatatctctgactgctgtttgtctccttccgttgccacagtttttgcagtttccgcaacattttggtacgttggctgggaagccgacaacctagttggcctcttgtgccaccgttgtcggggaaccgggggaggccacggtcgccagcccagtgacaggtggatagcgcgcaccggccattttgccgggtccagaccctcacccgggccgtggctttggcccacaccgcttcccaaacagactcagaaggagagtggaaacaggttcctggacaggacatcagactggtgagtgcccggggacatctgcccaagtcaggacccgccatatggcggaaggagaaactgatcacctttcagtgaccaaagggtcactcaggtcagtgtttgctcccttgggatcgggaggcttgtcaattctggtgtgtgtgtgtgagtgactggagagaacaagagcccgtgctccaccgtctttggactacggagccagagtgagtcctaacctgcagttccacagtgacctcatatggcttatggtggccctctttggagggatcctgacattggggtttatacaatcccacctatgctaagaggcacctgaaatatctcctcagggggagcagtcaggtggatgaagcgattgttacctgaggccttgccctcactgtttgtcttgcatcaccatcacagggtgggacttcacacaatgggtaaatcagcttccaagcccactgtcttagagtgtatggttaagaatttcaagaaaggattttctagagattatggtgttaagctgagtcctggaaaactgtgtaccctctgtaccctagagtggccctccttttgtgttggctggcctctggaagggaccttagatgtgttcacagttacagcagtatataatgttataacaggagaccctggacatccagaccaatttccatacattgatcaatggttggaaattgcctatttgagccccccatgggttcggttctgcaccacagaccagggacagtgtaaggtgctagtagcccagtccaagaagaaaaaccttgtctcaaaagaaggtgccacctatttatcaaggggaacctgaggatttgccccgtatgccaccaccttatgtgctgccggccccacctccaggagccaaaggtccccagatgccagatagcccaccaccttctgtttctcctcctccttctgcttctgaagttctggaggcgatatcacccctgcagccagatactccagaacctatgagcaggcgtctcctttcagctcagagagcagccactccagcattataaatgcccttacgagagacacagggaccacagcaagtcgcccccgatgggaccatacaagaggggggatgtttttattattaccagcccttttccaccgccgatctcctcaactggaaacaccatactccctcatattctgaaaagcctcaggcactgattgatctcttagaattcattttccagacacactgtcccacctggatagactgccggcaactcctttttactctgtttgacactgaagagtgctggcgaattgtaacagaagcccaaaaatggcttcaggccaatgcggggggttgagcagacttggcaaactgggtgagggaagccttcccagaagaaaacccccatttggactatgacactgaagaagggaaacgtagcctagacaggtaccagcaggccttcctacagggggcaaaagctggggctaaaaagcccactaagatcagtgcgatattacaagagccaaatgaaagcccagccaaattctatgagagactatgtgaggctttctgaatctacaccccttttgatcccaaggcccctgagaaccaacagatgataaatgctgcctttgtgggacaagcccaatcagatatccataaaaagctacagatattagaaggatttgcaggagagaatgccactaaactgttggaaatagccaacaaggtttttattgactgagaccaggtggcctgccgtgatgcagaaacattctctacatcgtaggggacaaggcacaaggcaagggaaaaggagtcccctggaacacgaccaatgtgcttactgcaaagaagagggacattggaaaaatgaatgccccaaccgtcctgagaaaaagaccaaggccccacctagccagtaccaatctgagccattcagcaccaacctgatcggcctagctgagtctgactggggggaccaggatctctccaactgggcccctgagagcctatggtcagaattcaagtagggggccaccccatagactttatggttgacacaggtgctgaactttctgtggttacacaacctgtagctcccctctcagggaaagaaaccaccattgttgaggtcacaggtaaccaaacccacaggcccttctgtggtcctcgatgatgctggttaggaggccatgaagtaatacatgaatttttttacctgcctgactgcccagtccccttgatgggaagagacgtgctggctaaaatgggggcacaaatttccttttctactgatggattgacccaacttaaattgacagaacccccctctcctttaatcatggctcttgctgtaaaaagggaagaggaatggcgcttgtactcttccccttcagaaatggggaccattcccccagaactagagactatatacccattggtttgggctgaaggaaaaccaccagcactggcaaaatgccacgctcctgtcttgattgatctaaaacccagagctcaaccgataaagctacggcaatactcaattcccagggaagctcgactgggaatccagtttcacctggataggctgcttcagcgtggactgttaataaaatgtcagtccccttggaacacccctttactgcccgtgaaaaaaactgggaacacaggactaccgcccagtacaggacttgagagccataaatgaagcaacagtcacattacacccgtccgtccctaacccgtataccctgctagggctgatcccctccactgctgagtggtttacttgcctggacttaaaagacgcctttttctgcctctgggtggcacctgccagtcagcccttgtttgcttttgaatgggaaaatccacatacagggacaaaggaacagctcacctggactagactcccacaaggattcaaaaactctcccactctttttagcggcgccttagctgctgacctggctgaatttcctggacaaaaactgggctgtgttttgctacagtatgttgacgacctcttactagctggcaccacggaggctcagtgcctagagggaacaagagctctcctttccctactgatggaggcagggtatcgggtatcaaagaaaaaggcacaaatctgtaaaaaacaagtcaagtatttgggcttcaacatcatgcagggccgacgaatgctggggactgaaaaaaaggaggcagtttgtgtcgttcctgtccctaccacctgccggaaggttcgtgagttccttggggcagcaggattctgccggatatggatccccaggttttcagacttggccaatcctctgtatgaggctctaaaaggggaaaaaaaggctccccttaaatggggaccaagccaggagacagtgtttcagacaatcaaaaccaaactcactgaggctccagccttgggacttcctgatgtaaccagagaatttaacctttttattcagaagaaaaatgggatggctttggaagtcttaactcaagaatttgggccttggcagaggccagtgacatatttgtctaaacaaattgactcagttgcagccggatggcctccctgtctctgagtgctggcagctaccaccttgttggtgagagaggctgacaagttgaccctgggacaaaacctcaatgttaaattcccatactcagttgtaaccctaatggataccagtggccaccattggctcacacatgcacgaataactcaatatcaagggttactatgtgaaaatccatgggtaaaactggaggttgtacggactctgaacccagccacttttctgccagataaagaggggccccacagaccagctggggcacaacactgtggactgtctccatttgaggatatggaagtggacttcactgaggtcacccctagtaaggggtacaaatatttactagtttttatctgtactttttcaggatgggtagaagtcttccctacccaaactgaaaaggcaagggaagtaaccaaggcactcctgagagacattattcccagatatggaatgcctctgaccatcgggtcagataatggaccggcatttgtggccaaaacagtacaacaggtggcaaaagctttacagatctgatggaaactacattctgcttgtcgccctcaaagttcagggaaagtagaacacatgaaccgaacccttaaacagaccctggcaaagttatgtcaggaaactggcttgccctggatagacatgtttccggtgggcctcttgaaagtgagatgctcaccctgagtgggaataggattctcaccatttaaaatcttatatggaaggccacctccactaatcagtttaaagggaaacaccagggagttgggagacttggaattacataaacaattacaaggactggggctcactatttctcagatacataaatgggtcacagacagaatacctgtgtccttaggtataacagtacacccacaaaagccgggggaccaggtgtggataaaggagtggaaaaaggagcccttgaggccagtatggaagggcccctatactgtaattctaaccatccccactgctcttaaagtaacaggaatagatgtttggatccatcatttcagagttaaaccagctggcccagctgacgaccatggagactgggagactgccctcgatccggagagacctcttcgcctgacaatacagagaaggagatgacgatctcaaagccctgctttgaccacactggaagctggtcagtcaacgcacggctgaagcttgaggaatcgactgcctgtgagcccaaatggaaggagggtttcaaaataaacattcgcattgacggaaaaggccgtgaccctagagctgtgctacatttccagagaatcacgtttgtgttacaaggtgcctctcacagggtctttcattccttttatgaagagataaaaaaaaaaaaacaccccacctcccattccagccacaactaagaacttgttcttagccctggcagaaactattgcacaaactctcaaggtctcctcttgttatgtatgcaggggaacgaacacaggagaccactggccttggcaagccagaaaactggacccattagagcctcataatgagactgcatacccccaactcaccgatagggtatggctcctcaaaactgccattattgggagaaattgtcttgcgaggtggggaggacggtttaatgtttcagttggaagcctaatatgtttaggcctaaggtattataatctgactgctctaaaaactcaatggtggtcatcctccaatctctcagagcccaaacctaatcccttgtctaacttttccttcctttgacaagcatggaaagatatcagtgctgatgtccagtggcgggcaccaaagggattatattggatttgtgaaaaaaatggcctattccatactccccccgaattgggctggggcatgtgtactgggaacaatcagaccttccttcttcctgctcccgctgtcactaggggagcaactgggagtgcctatatacagggcacagggtgcccagagagactggagggctctccaaattggagactggaaagatgatgaatggcccccagaacagataattcaatattatgggcctgcccctgggcagaggatggctcttggggatatcgcacccctatctatatgctgaaccgcatcatcagactacaggcagttttggaacttataacaaatgacactgcaagggccttgactatattggcccaacaacaaactaaaatgtgcagtgcaatctaccaaaattgcttggccttggattatttacttgcttctgaaggaggggtttgtggaaaatttaacttaagtaattgctgtctacaaatagatgacaccagaaaggtggtagaagaaattgctgaccgcatgactaaactagcccatgtacctgtacaaacttggaaaggatgggatgcagacagtctctttggtaagtggttctcttggttgggaggaattaagacaatggttggaatagtcatggttatactcgcagggtgcctacttgttccctgc

SEQ ID NO: 155 - DNA, 8445 bp, artificial
  ss1259 sequence
tggtttgtgatattttaaaatgattagtttgtaaaagcgcgggctttgttgtgaaccccataaaagctgtcgcgactccacactcggggccgcagtcctctacccctgcgtggcgtacgactgtgggccccagcgcgctcggaataaaaatcctcttgctgtttgcatcaagaccgcttctcgtgagtgatttggggtgttgcctcttccgagtccggacgagggggattttcactcgactggcctttcacttggtgcgttggccgggaatcctgtgaccaccccttacacccgagaacccacttggaggtaaagggatcccctttggaacgtgtgtgtgtcggccggcgtctctgttctgagtgtctattctcggtaatgcgtgcttttgctttgcagctgtcctctcagaccgtgaggactggaggactgtgatcagcagacgtgctaggaggatcacaggctgccaccctgggggatgccccgggaggtggggagagccagggacgcctggtggtctccttctgtcggtcagaggaccaagttctgttgttgaagtgaaaacttccccctccgtggccgtccgactcttttgcctgcttgtgggagacgcggacgggtcgtgtgtgtctggatctgttggtttctgttttgtgcatctttgtcttgtgcgtccttgtctacagttttaatatgggacaacccctcttagtttgactctcgaccattggactgaagttaaattcagggctcataatttgtcagttcaggttaagaagggaccttggcagactttctgtgcctctgaatggccgacattcaatgttggatggccatcagaggggacctttaattctgagattatcctggctgttaaagcaattatttttcagactggacccggctctcatcccgatcaggagccctatatccttacgtggcaagatttggcagaggatcctccgccatgggttaaaccatggctgaataaaccaagaaagccaggtccccgaattctggctcttggagagaaaaacaaacactcggctgaaaaagtcaagccctctcctcatatctaccctgagattgaggagccgccggcttggccagaaccccaatctgttcccccacccccttatccggcacagggtgctgcgaggggaccctctgcccctcctggagctccggcggtggagggacctgctgcagggactcggagctggaggggcaccaccccggagcggacagacgagatcgtgacattaccgctgcgcaagtacggccctcccatactggggggccaattgcagcccctccagtattggcccttttcttctgcagatctctataattggaaaactaaccatccccctttttcggaggatccccaacacctcacagggttggtggagtcccttatgttctctcaccagcctacttgggatgattgtcaacagctgctgcagacactcttcacaactgaggagcgagagagaattctgttagaggctagaaaaaatgttcctggggccgacgggcgacccacgcaattgcaaaatgagattgacatgggatttccctgactcaccctggttgggactacaacacggctgaaggtagggagagcttgaaaatctatcgccaggctctggtggcaggtctccggggcgcctcaagacggcccactaatttggctaaggtaagagaggtgatgcagggaccgaatgaacctccctcggtttttcttgagaggctcatggaagccttcaggcggttcaccccttttgaccctacctcggaggcccagaaagcctcagtggccctggccttcataggacaatcggcccaggatatcagaaggaagcttcagagactggaagggttacaggaggctgagttacatgatctagtgaaggaggcagagaaagtgtattacaaaagggagacagaagaagaaagggaacaaagaaaagagagagaaagagaggaaagggaggaaagacgtgatagacggcaagagaagaatttgactaagatcttggccgcagtggttgaaaggaaaagcaatagggaaagagagagagattttaggaaaattaggtcaggccctagacagtcagggaacctgggcaataggaccccactcgacaaggaccaatgtgcatattgtaaagaaaaaggacactgggcaagggactgccctaagaagggaaacaaaggactgaaggtcctagctctggaagaagataaagactagggaagacggggttcggaccccctccccgagcccagggtaactttaaaggtggaggggcaaccagttgagtttctggttgataccggagcgaaacattcagtgctactatagccattaggaaaactaaaagataaaaaatcctgggtgatgggcgccacagggcaacgacagtatccatggactacccgaagaacagttgacttgggagtgggacgggtaacccactcgtttctggtcatcatccctgagtgcccagcacccctcttatgtagagacttactgaccaagatgggagcacaaatttcttttgaacaaggaaaaccagaagtgtctgcaaataacaaacctatcactgtgttgaccctccaattagatgacgaatatcgactatattctcccctagtaaagcctgatcaaaatatacaattctggttggaacagtttccccaagcctgggcagaaaccgcagggatgggtttggcaaagcaagttcccccgcaggttattcaactgaaggccagtgctacaccagtatcagtcagacagtaccccttgagtaaagaagctcaagaaggaattcggccgcatgttcaaagattaatccaacagggcatcctagttcctgtccaatctccctggaatactcccctgctaccggttagaaagcctgggaccaatgactatcgaccagtacaggacttgagagaggtcaataaatgggtgcaggatatacacccaacggtcccgaacccttataacctcttgtgtgctctcccgccccaatggagctggtatacagtattggacttaaaggatgtcttcttctgcctgagattacatcccactagccaaccactttttgcctttgaatggagagatccaggtacgggaagaaccgggcagctcacctggacccgactgccccaagggttcaagaactccccgaccatctttgacgaagccctacacagagacctggccaacttcaggatccaacaccctcaggtgaccctcctccagtacgtggatgacctgcttctggcgggagccaccaaacaggactgcttagaatgtacgaaggcactactgctggaattgtctgacctaggctacagagcctccgctaagaaggcccagatttgcaggagagaggtaacatatttggggtacagtttgtggggtgggcagcgatggctgacgggggcatggaagaaaactgtagtccagataccggccccaaccacagccaaacaagtgagagagttttggggacagctggattttgcagactgtggatcccgcggtttgcgaccttagcagccccactctacccactaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccggggagttttaacccaaaccttaggaccatggaggagacctgttgcctacctgtcaaagaagctcgatcctgtagccagtggttggcccgtatgcctgaaggctatcgcagctgtggccatactggtcaaggacgctgacaaattgactttgggacagaatataactgtaatagccccccatgcgttggagaacatcgttcggcagcccccagaccgatggatgaccaacgtctgcatgacccgctatcaaagcctgcttctcacagagagggtcacgttcgctccacgagccgctctcaaccctgccactcttctgcctgaagagactgatgaaccagtgactcatgattgccatcaactgttaatcgaggagactggggtccgcaaggaccttacagacataccgctgactggagaagtgctgacctggttcactgacggaagcagctatgtggtggaaggtaagaggatggccggggcggcagtggtggacgggacccacacgatctgggccagcagcctgctggaagggacttcagcacaaaaggctgagctcatggccctcacgcaagctttgcagctggccgaagggaaatccatagacatttatacggacagcaggtatgcttttgcgactgcacacgtacacggggccatctataagcaaagggggttgcttacctcagcagggagggaaataaagaacaaagaggaaattctaagcctattagaagccttacatttgccaaaaaggctagctattatacactgtcctggacatcagaaagccaaagatctcatatccagagggaaccagatggctgaccgggttgccaagcaggcagcccagggtgttaaccttctgcctataatagaaatgcccaaagccccagaacccggacgacagtacaccctagaagactggcaagagataaaaaagatagaccagttctctgagactccagaggggacctgctatacctcagatgggaaggaaatcctgccccacaaagaagggttagaatatgtccaacagatacatcgtctaacccacctaggaactaaacacctgcagcagttgatcagaacatccccttatcatgttctgaggctaccaggagtggctgactcggtggtcaaacattgtgtgccctgccagctggttaatgctaatccttccagaatacctccaggaaagagactaaggggaagccacccaggtgctcactgggaagtggacttcactgaggtaaagccggctaaatacggaaacaaatgtctattggcttttgtagacaccttttcaggatgggtagaggcttatcctactaagaaagagacttcaactgtggtggctaaaaaaatactggaggaaatttttccaagatttggaatacctaaggtaatagggtcagacaatggtccaactttcgttgcccaggtaagttagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccttatgaattgctctatgggggaccccccccccggttggcagaaattgcctttgtacatagtgctgatgtactgctttcccagcctttgttctctaggcttaaggcactcgagtaggtgaggcagcgagcatggaagcagctctgggaggcctactcaggaggagacttgcaagttccacatcgcttccaagttggagattcagtctatgttagacgccaccgtgcaggaaacctcgagactcggtggaagggcccttatctcgtacttttgaccacaccaacggctgtaaaagttgaaggaatctccacctagatccatgcatcccacgttaagccggcgccacctcccgattcggggtggagagccgaaaagactgaaaacccccttaagcttcgcctccatcgcttggttccttactctgtaaataactcctcaagttaatggtaaacgcccgaactcccacaaacccttatctctcacctggttacttactgactccagtacaggtattactattaacagcactcaaggggaggctcccttagggacctggtggcctgagttatatgtctgccttcgatcggtaatccctggtctcaacgaccaggccacaccccccgatgtactccgtgcttatgggttttatgtttgcccaggacccccaaataatgaagaatattgtggaaatcctcaggatttcttttgcaagcaatggagctgcgtaacttctaatgatgggaattggaaatggccagtctctcagcaagacagagtaagttactcttttgttaacaatcctaccagttataatcaatttaattaccgccatgggaaatggaaagattggcaacagcaggtacaaaaagatgtacgaaataagcaaataagctgtaatttgttagacctagattacttaaaaataagtttcactgaaaaaggaaaacaagaaaatattcaaaagtgggtaaatggtatgtcttggggaatagtgtactatggaggctctgggagaaggaaaggatctattctaactattcgcctcagaatagaaactcagatggaacctccggttgctataggaccaaataagtgtttggccgaacaaggacctccaatccaagaacagaggccatctcttaacccctctgattacaatacagcctctggatcagtccccactgagcctaacatcactattaaaacaggggcaaaactttttagcctcatccagggagcttttcaagctcttaactccacaactccagaggctacctcttcttgttggctttgcttagcttcaggcccaccttactatgaggaacggctagaggagggaaattcaatgtgacaaaggaacatagagaccaatgtacatggggatcccaaaataagcttacccttactgaggtttctggaaaaggcacctgcatagggagggttcccccatcccaccaacacctttgtaaccacactgaagcctttaatcgaacctctgagagtcagtatctggtacccggttatgacaggtggtgggcatgtaatactggattaaccccttgtgtttccaccctggttttcaaccaaactaaagacttttgcgttatggtccaaattgtcccccgggtgtactactatcccgaaaaagcggtccttgatgaatatgactatagatataatcagccaaaaagagaacccatatccctgacactagctgtaatgctcggattgggagtggctgcaggcgtgggaacaggaacggctgccctaatcacaggaccacaacagctggagaaaggacttagtgacctacatcgaattgtaacggaagatctccaagccctagaaaaatctgtcagtaacctagaggaatccctaacctccttatctgaagtggttctacagaacagaagggggttagatctgttatttctaaaagaaggtgggttatgtgtagccttaaaagaggaatgctgcttttatgtggatcattcgggagctatcagggactccatgagcaagctcagagaaaggttagaaaaacgtcacagagaaaaagaggctggccaaggatggtttgagggatggttcaacaagtccccatgggtgaccaccctgctttctgctctaacaggacccctagtaatactgctcctgttgcttacagttgggtcttgcttaattaatcggtttgttgcctttgttagagaacaagtgagtgcagtttggatcatggtacttagacagcagtaccaaggccttccgagccaaggagaaactgacctttagccttcctagttctaagattagaactattaacaagagaagaagtggggaatgaaaggatgaaaatgcaacctgaccctcccagaacccaggaagttaataagaagctctaaatgccctcaaattccagaccctgttccctataggtaaaagatcatactttttgctgttttagggcttgctttctgttctgtacaaaactatgtggaaggggaaaaacaggcccctgagtatgtgcctctatgcatgaaacttcttgaaactgcttgagataacaggaaaaagggttcctaactgcttgtttggcttctgtaaagctgcttgcataagataaaaagaggagaagttaatcgcctaaccgaccccagtaagatcggttgctccacaaaatgttgaaaatcctgataaatatatcttggcgacaatatgtctcccccacccagggacaggcacaaacacgtaactccagaacaacttaaaattaattggtccacaaagcgcgggctctcgaagttttgaattgactggtttgtgatattttaaaatgattagtttgtaaaagcgcgggctttgttgtgaaccccataaaagctgtcacgactccacactcggggccgcagtcctctacccctgcgtggcatacgactgtgggccccagcgcgctcggaataaaaatcctcttgctgtttgcatcaagaccgcttctcgtgagtgatttggggtgttgcctcttccgagtccagacgagggggattttca

SEQ ID NO: 156 - DNA, 8681 bp, artificial
  ss1263 sequence
tgccctcgagttccagaccctgttccctataggtaaaagatcatactttttgctgttttagggcttgctttctgttctgtacaaaactatgtggaaggggaaaaacaggcccctgagtatgtgcctctatgcatgaaacttcttgaaactgcttgagataacaggaaaaagggttcctaactgcttgtttggcttctgtaaagctgcttgcataagataaaaagaggagaagttaatcgcctaaccgaccccagtaagatcggttgctccacaaaatgttgaaaatcctgataaatatatcttggcgacaatatgtctcccccacccagggacaggcacaaacacgtaactccagaacaacttaaaattaattggtccacaaagcgcgggctctcgaagttttgaattgactggtttgtgatattttaaaatgattagtttgtaaaagcgcgggctttgttgtgaaccccataaaagctgtcgcgactccacactcggggccgcagtcctctacccctgcgtggcgtacgactgtgggccccagcgcgctcggaataaaaatcctcttgctgtttgcatcaagaccgcttctcgtgagtgatttggggtgttgcctcttccgagtccggacgagggggattttcactcgactggcctttcacttggtgcgttggccgggaatcctgtgaccaccccttacacccgagaacccacttggaggtaaagggatcccctttggaacgtgtgtgtgtcggccggcgtctctgttctgagtgtctattctcggtaatgcgtgcttttgctttgcagctgtcctctcagaccgtgaggactggaggactgtgatcagcagacgtgctaggaggatcacaggctgccaccctgggggatgccccgggaggtggggagagccagggacgcctggtggtctccttctgtcggtcagaggaccaagttctgttgttgaagtgaaaacttccccctccgtggccgtccgactcttttgcctgcttgtgggagacgcggacgggtcgtgtgtgtctggatctgttggtttctgttttgtgcatctttgtcttgtgcgtccttgtctacagttttaatatgggacaacccctcttagtttgactctcgaccattggactgaagttaaattcagggctcataatttgtcagttcaggttaagaagggaccttggcagactttctgtgcctctgaatggccgacattcaatgttggatggccatcagaggggacctttaattctgagattatcctggctgttaaagcaattatttttcagactggacccggctctcatcccgatcaggagccctatatccttacgtggcaagatttggcagaggatcctccgccatgggttaaaccatggctgaataaaccaagaaagccaggtccccgaattctggctcttggagagaaaaacaaacactcggctgaaaaagtcaagccctctcctcatatctaccctgagattgaggagccgccggcttggccagaaccccaatctgttcccccacccccttatccggcacagggtgctgcgaggggaccctctgcccctcctggagctccggcggtggagggacctgctgcagggactcggagctggaggggcaccaccccggagcggacagacgagatcgtgacattaccgctgcgcaagtacggccctcccatactggggggccaattgcagcccctccagtattggcccttttcttctgcagatctctataattggaaaactaaccatccccctttttcggaggatccccaacacctcacagggttggtggagtcccttatgttctctcaccagcctacttgggatgattgtcaacagctgctgcagacactcttcacaactgaggagcgagagagaattctgttagaggctagaaaaaatgttcctggggccgacgggcgacccacgcaattgcaaaatgagattgacatgggatttccctgactcaccctggttgggactacaacacggctgaaggtagggagagcttgaaaatctatcgccaggctctggtggcaggtctccggggcgcctcaagacggcccactaatttggctaaggtaagagaggtgatgcagggaccgaatgaacctccctcggtttttcttgagaggctcatggaagccttcaggcggttcaccccttttgaccctacctcggaggcccagaaagcctcagtggccctggccttcataggacaatcggcccaggatatcagaaggaagcttcagagactggaagggttacaggaggctgagttacatgatctagtgaaggaggcagagaaagtgtattacaaaagggagacagaagaagaaagggaacaaagaaaagagagagaaagagaggaaagggaggaaagacgtgatagacggcaagagaagaatttgactaagatcttggccgcagtggttgaaaggaaaagcaatagggaaagagagagagattttaggaaaattaggtcaggccctagacagtcagggaacctgggcaataggaccccactcgacaaggaccaatgtgcatattgtaaagaaaaaggacactgggcaagggactgccctaagaagggaaacaaaggactgaaggtcctagctctggaagaagataaagactagggaagacggggttcggaccccctccccgagcccagggtaactttaaaggtggaggggcaaccagttgagtttctggttgataccggagcgaaacattcagtgctactatagccattaggaaaactaaaagataaaaaatcctgggtgatgggcgccacagggcaacgacagtatccatggactacccgaagaacagttgacttgggagtgggacgggtaacccactcgtttctggtcatcatccctgagtgcccagcacccctcttatgtagagacttactgaccaagatgggagcacaaatttcttttgaacaaggaaaaccagaagtgtctgcaaataacaaacctatcactgtgttgaccctccaattagatgacgaatatcgactatattctcccctagtaaagcctgatcaaaatatacaattctggttggaacagtttccccaagcctgggcagaaaccgcagggatgggtttggcaaagcaagttcccccgcaggttattcaactgaaggccagtgctacaccagtatcagtcagacagtaccccttgagtaaagaagctcaagaaggaattcggccgcatgttcaaagattaatccaacagggcatcctagttcctgtccaatctccctggaatactcccctgctaccggttagaaagcctgggaccaatgactatcgaccagtacaggacttgagagaggtcaataaatgggtgcaggatatacacccaacggtcccgaacccttataacctcttgtgtgctctcccgccccaatggagctggtatacagtattggacttaaaggatgtcttcttctgcctgagattacatcccactagccaaccactttttgcctttgaatggagagatccaggtacgggaagaaccgggcagctcacctggacccgactgccccaagggttcaagaactccccgaccatctttgacgaagccctacacagagacctggccaacttcaggatccaacaccctcaggtgaccctcctccagtacgtggatgacctgcttctggcgggagccaccaaacaggactgcttagaatgtacgaaggcactactgctggaattgtctgacctaggctacagagcctccgctaagaaggcccagatttgcaggagagaggtaacatatttggggtacagtttgtggggtgggcagcgatggctgacgggggcatggaagaaaactgtagtccagataccggccccaaccacagccaaacaagtgagagagttttggggacagctggattttgcagactgtggatcccgcggtttgcgaccttagcagccccactctacccactaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccggggagttttaacccaaaccttaggaccatggaggagacctgttgcctacctgtcaaagaagctcgatcctgtagccagtggttggcccgtatgcctgaaggctatcgcagctgtggccatactggtcaaggacgctgacaaattgactttgggacagaatataactgtaatagccccccatgcgttggagaacatcgttcggcagcccccagaccgatggatgaccaacgtctgcatgacccgctatcaaagcctgcttctcacagagagggtcacgttcgctccacgagccgctctcaaccctgccactcttctgcctgaagagactgatgaaccagtgactcatgattgccatcaactgttaatcgaggagactggggtccgcaaggaccttacagacataccgctgactggagaagtgctgacctggttcactgacggaagcagctatgtggtggaaggtaagaggatggccggggcggcagtggtggacgggacccacacgatctgggccagcagcctgctggaagggacttcagcacaaaaggctgagctcatggccctcacgcaagctttgcagctggccgaagggaaatccatagacatttatacggacagcaggtatgcttttgcgactgcacacgtacacggggccatctataagcaaagggggttgcttacctcagcagggagggaaataaagaacaaagaggaaattctaagcctattagaagccttacatttgccaaaaaggctagctattatacactgtcctggacatcagaaagccaaagatctcatatccagagggaaccagatggctgaccgggttgccaagcaggcagcccagggtgttaaccttctgcctataatagaaatgcccaaagccccagaacccggacgacagtacaccctagaagactggcaagagataaaaaagatagaccagttctctgagactccagaggggacctgctatacctcagatgggaaggaaatcctgccccacaaagaagggttagaatatgtccaacagatacatcgtctaacccacctaggaactaaacacctgcagcagttgatcagaacatccccttatcatgttctgaggctaccaggagtggctgactcggtggtcaaacattgtgtgccctgccagctggttaatgctaatccttccagaatacctccaggaaagagactaaggggaagccacccaggtgctcactgggaagtggacttcactgaggtaaagccggctaaatacggaaacaaatgtctattggcttttgtagacaccttttcaggatgggtagaggcttatcctactaagaaagagacttcaactgtggtggctaaaaaaatactggaggaaatttttccaagatttggaatacctaaggtaatagggtcagacaatggtccaactttcgttgcccaggtaagttagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccttatgaattgctctatgggggacccccccccggttggcagaaattgcctttgtacatagtgctgatgtactgctttcccagcctttgttctctaggcttaaggcactcgagtaggtgaggcagcgagcatggaagcagctctgggaggcctactcaggaggagacttgcaagttccacatcgcttccaagttggagattcagtctatgttagacgccaccgtgcaggaaacctcgagactcggtggaagggcccttatctcgtacttttgaccacaccaacggctgtaaaagttgaaggaatctccacctagatccatgcatcccacgttaagccggcgccacctcccgattcggggtggagagccgaaaagactgaaaacccccttaagcttcgcctccatcgcttggttccttactctgtaaataactcctcaagttaatggtaaacgcccgaactcccacaaacccttatctctcacctggttacttactgactccagtacaggtattactattaacagcactcaaggggaggctcccttagggacctggtggcctgagttatatgtctgccttcgatcggtaatccctggtctcaacgaccaggccacaccccccgatgtactccgtgcttatgggttttatgtttgcccaggacccccaaataatgaagaatattgtggaaatcctcaggatttcttttgcaagcaatggagctgcgtaacttctaatgatgggaattggaaatggccagtctctcagcaagacagagtaagttactcttttgttaacaatcctaccagttataatcaatttaattaccgccatgggaaatggaaagattggcaacagcaggtacaaaaagatgtacgaaataagcaaataagctgtaatttgttagacctagattacttaaaaataagtttcactgaaaaaggaaaacaagaaaatattcaaaagtgggtaaatggtatgtcttggggaatagtgtactatggaggctctgggagaaggaaaggatctattctaactattcgcctcagaatagaaactcagatggaacctccggttgctataggaccaaataagtgtttggccgaacaaggacctccaatccaagaacagaggccatctcttaacccctctgattacaatacagcctctggatcagtccccactgagcctaacatcactattaaaacaggggcaaaactttttagcctcatccagggagcttttcaagctcttaactccacaactccagaggctacctcttcttgttggctttgcttagcttcaggcccaccttactatgaggaacggctagaggagggaaattcaatgtgacaaaggaacatagagaccaatgtacatggggatcccaaaataagcttacccttactgaggtttctggaaaaggcacctgcatagggagggttcccccatcccaccaacacctttgtaaccacactgaagcctttaatcgaacctctgagagtcagtatctggtacccggttatgacaggtggtgggcatgtaatactggattaaccccttgtgtttccaccctggttttcaaccaaactaaagacttttgcgttatggtccaaattgtcccccgggtgtactactatcccgaaaaagcggtccttgatgaatatgactatagatataatcagccaaaaagagaacccatatccctgacactagctgtaatgctcggattgggagtggctgcaggcgtgggaacaggaacggctgccctaatcacaggaccacaacagctggagaaaggacttagtgacctacatcgaattgtaacggaagatctccaagccctagaaaaatctgtcagtaacctagaggaatccctaacctccttatctgaagtggttctacagaacagaagggggttagatctgttatttctaaaagaaggtgggttatgtgtagccttaaaagaggaatgctgcttttatgtggatcattcgggagctatcagggactccatgagcaagctcagagaaaggttagaaaaacgtcacagagaaaaagaggctggccaaggatggtttgagggatggttcaacaagtccccatgggtgaccaccctgctttctgctctaacaggacccctagtaatactgctcctgttgcttacagttgggtcttgcttaattaatcggtttgttgcctttgttagagaacaagtgagtgcagtttggatcatggtacttagacagcagtaccaaggccttccgagccaaggagaaactgacctttagccttcctagttctaagattagaactattaacaagagaagaagtggggaatgaaaggatgaaaatgcaacctgaccctcccagaacccaggaagttaataagaagctctaaatgccctcaaattccagaccctgttccctataggtaaaagatcatactttttgctgttttagggcttgctttctgttctgtacaaaactatgtggaaggggaaaaacaggcccctgagtatgtgcctctatgcatgaaacttcttgaaactgcttgagataacaggaaaaagggttcctaactgcttgtttggcttctgtaaagctgcttgcataagataaaaagaggagaagttaatcgcctaaccgaccccagtaagatcggttgctccacaaaatgttgaaaatcctgataaatatatcttggcgacaatatgtctcccccacccagggacaggcacaaacacgtaactccagaacaacttaaaattaattggtccacaaagcgcgggctctcgaagttttgaattgactggtttgtgatattttaaaatgattagtttgtaaaagcgcgggctttgttgtgaacccca

SEQ ID NO: 157 - DNA, 8366 bp, artificial
  ss1264 sequence
tgtctgcttggggatgggcgggggaggtccaggatgcttacatgggaaaatcaagaccttgtagtgtatgaaagttactgagaacaaagacctggtgctcagactctggaggtgactcctctgagcccacaccagtgctgaataaaccttgcttttccatatctctgactgctgtttgtctccttccactgccacggtttttgtggtttccacaacattgttggtgtgtttgtgggaagccaacaaccgagctggcctcttgtgccaccgttgtcagggaacttggggacgccatggtcgctggcccagtgacaggtggatagcatgcaccggccattttgccagatccagaacctcactcgggccatgctggccttggctcacaccgctttccgaacagactcagaaggagagtggtcaggatgttgaactggtgagtgccccggggacacctgcccaagtcaggacccaccatacagtggaaggagagactgatcacctctcagtgaccaaagggtcactcaggtcagggtttgctcccttgggatcaggaggcttgtcaattctggtgtgtgtgtgtgagagtgactggagagaaggagagcctgtgctccaccatctttggactatggagccagagtgagtcctaacctgcagttccacggtgaccctcatatggcttatggtggccctctttggagggatcctgacgttggggtttatacagtcccacctatgctaagaggctcctgaaacatctcctctgggggagcggtcaggcggatgaagcgattgttacctgaggccttaacctcgctgtttttcttgcatcaccatcacagggtgggacttcacacaatgggtaaatcagcttccaagcccactgtcttagagtgtatggttaagaattttaggaaaggattttctagagattatggtgttaaactgagtcctggaaaactatgtacactttgtaccctcgagtggtcctcctttggtgttggctggcctctggaagggaccttagatgtcttcacagttgtagcagtatataatgttataacaggagaccctggacacccagaccaatttctgtatattgatcaatggctggaaattgcctatttgaggcccctatgggtttggttctgcaccacagaccagggacagtgtagggtgccactagctcagtccaagaagaaaccttgtctcaaaaaacggtgccacctatttttcaaggggaacctgaggactcaccccctatgccaccaccttatgtgttgctggccccacctccgggagccgaaggtctccagatgccagatagcccaccgccttctgtttttcctcctccttctgcttctgaagttcctgaggcaatatcatccctgccgccagattctccagaaccaatgagcaggcatctccggtcagctcagggagcagccactccagcattgcatgcccttacgggagacacggggaccatggcaagtcgcctctgatgggaccagacaagaggggggatgggttttttattaccagcccttttccaccgccgatctcctcaactggaaacaccatactccctcatattctgaaaagcctcaggcgctgattgatctcttagaattcattttccagacacactgtctcacctggatagactgccagcaactcttttttactctgtttgacactgaagagcactggcaaattataacagaagcccaaaaatggcttcaggccaatgcagggggttgagcagacttggcaaactgggtaagggaagccttcccagaagaaaacccccactgggactatgacactgaagaaaggaaatgtaacctagacaggtaccagcaggccttcctacagggggcaaaagctggggctaaaaggcctactaatatagctaagaccagtgagatactacaagagccgaatgaaagcccagccaaattctatgagagactatgtgaggctttccgaatctacaccccttttgatcctgaggcccctgagaaccaacggatgataactgcttcctttgtgggacaagcccaatcagacatccataaaaaactacaggaactagaaggatttgcaggagagaatgccactaaactgttggaaatagccaacaaggtttttattaaccgagaccaggtggcctgccgtgatgcagaaacattctctacattgtaggggacaaggcccaaggccagggaaaagaagtcccctggaacatgaccaatgtgcttactgcaaagaagagggacattggaaaaatgaaggcctcaaccgtcctgagaaaaagaccaagaccccacctagctggtattgatctgagccattcagcaccaacctgatcggcctagctgagtctgattaggggggaccaggctctctccaactgggcccctgagagcctatggtcagaattcaagtagggggccaccccgtagactttatggttgacacaggtgccaaactttctgtggttacaacctgtagctcccctctcagggaaagaaaccatcatcattggggccacaggtaaccaaacccacaggcccttctgtggtcctcaacgatgtcgattaggaggccatgaagtaatacatgaatttctttacctgcctgactgcccagtccccctgatgggaagagacctgctggctaaaatgggggcacaaatttcctgttctactgatggatcggcccaactcaaatggacagaacccccctctcctttaatcatggctcttgctgtaaaaagggaagaggaatggcacttgtactcttccccttcagaaatggggaccattcccccagaactagagactaaatacccattggtttgggctgaaagaaacccaccaggactggttcacctggataggctgcttcagcacagactgttaataaaatgtctgtccccttggaacacccctttactgtccataaaaaaaacaggaacacaggactaccgcccagttcaggacttgagagccataaatgaagcaacagtcacattacacccgtccgtccctaacctgtataccctgctaggactgagcccctccactgctgagtcgtttacttgtctggacttaaaaaacaccttttttctgcctctgggtggcacctgccagtcagcccttatttgcttttgaatggaaaaatccacatacagggacaaaggaacagctcacctggaccaaactcccacaaggattcaaaaactctcccaagctttttagcggagccctagctgctgacctgactgaatttcctggacaaaaattgagctgtgttttgctacagtatgtttatgacctcttactagctggcaccacggaggcttagtgcccagagggaacaagagctctcctttccctactgatggaggcagggtatcgggtatcaaagaaaaaggcacaaatctgtaaaaaacaagtcaagtatctgggatttaacatcatgcagggtgtacaaatgctggggactgaaagaaagcaggcagtttgtgccattcctgtccctaccacccgccggaaggttcgtgagttcctaggggcagcaggattctgccagatatagatccctgggttttcagacttggccaggcctctgtatgaggctctaaaaggggaaaaaaaggctccccttaaatggggaccaagccaggaggcagcatttcagacaatcaagaccaaactcactgaggctccagccttggggcttcctgatgtaaccagagaatttaatctttttgttcatgaaaaaaaaagtgggatggctttgggggtcttaactcaagaatttgggccttggcagaggccagtggcatatctgtctaaacaaattgactcagttgcggccggatggcctccctgcctctgagtgctggcagctaccaccttgttggtgagagaggctgacaagttgactctgggaccaaacctcaatgttaaattcccatactcagttgtaaccctaatggataccaggggccaccattggctcacacatgcatgaatgactcaatatcaagggtcactatgtgaaaattcacaggtaaaactggaggttgtacaaactctgaacccagccacttttctgccagatgaagcagggcccccagaccataacttcttggaggtactagatgaggtgttttccagcaggcctgacttggctgataaaccactccaaaatcctgacctggttttatatactgatggcagcagctttatggaggatggaaaaaggatggaaggttatgctgcggtatctgacttaaaagtgatagaagcagaggtgcttcctcaaggctggtcagcacagagagcagaattatgggccttaatcagagcactggagcacagccaagaccagcaagttaatatctataccaactcatggtatgcctttgcaactttgtatgttcatgaagccttatataaagaaagacgatcctcactgctgaaggaaaagggattaaaaaccaggctgaaatcttaaagctcctagaggcagtatgggaacctaaagaagttgcagttatcccctgtaaaggccaccaaaatggagacaacccagtgacaaaaggaaaccgtagtgctaatgcagctgccacacaggcagcctggagacaacagccagacaaacctaaggtcttgctggtcccagaagtgccagctgtccccagatattctccagaggaagaaaaatggataaaggaggaaggaggaactaaaactaagaggggatggtgagtcatataggaccaccgagtttatgttctggaacaactggcctgcaaactagtccaccaacaacacgagctaacccacatgggcaaaactgtcttagagaccctactgggccagtattatctcattgttcatcttcatgcactctgctcctctgtctcccaaagatgcatagcctgtttgcagaataatgcccgccaggggaccaacagaccagctggggcacaacactgtggactgtctccatttgagggtatcctgagagacattattcccagatatggaatgcctctgaccatcaggtcagataacagaccggcatttgtggcgaaaacagtacaacaggtggcaaaagctttacagatccgatggaaactacattctgcttatcaccctcaaagttcagggaaagtagaacacatgaactggacccttaaacagatcctggcaaagttatgtcaggaaactggcttgccctggatagacatgttgtcagtggccctcctaaaagtgagatgttcaccccgagtgggaataggattctcaccatttaaaatcttatatggaaggccacctccactaatcagtttaaaggggggaaacaccagggagttgggagacttggaattacataaacaattacaaggactggggctcactatttctcagatacataaatgggtcacagacagaatacctgtgtccttaggtataacagtacacccacaaaagccgggggaccaggtgtggataaaggagtggaaaaaggagcctttgaggctggtatggaagggcccctatactgtaattctaaccacccccaccgcccttaaagtaacagggatagatgcttggatccatcattccagagttaaaccggctggcccagctgacgaccgtggagactgggagactgccctcaatccagagagacttcttcacctgacaacacagaggaggagatgactatctcaaagccctgctctgaccacaccggaagctggtcagtcaatgcacggctgaagcttgaggaatcagctgcctggtaaaataaactgccttacctactttccacaagagactttcttactgttatatactgttatcttatatccaacatgtatgtttgctgcctgttgctgttaatctgatcccctttggttctgccaggatccatttcctcatgtgacccatgcattcgcgtgacctgatcagatcaaggggttacatgaactttctttactccactcatttctcctgttccagagaaattcacagaaattgtactcacaacaggaccacttattctatctgtcaacagggggaccaatatactttctttgttccactatactcaccaactgaggaatggttaggagtccagcgctctcctaaatcaaggcagctaatgaatctgacccaaattaccaactccaagttgccagtgtcaatactttttgatgcctgtgaagctgcaaatgggtcatggacttctactagaccatgtggtagcccatcatgggaaagagaatataggctccagcataaatatatgtgctgggggaccacctggagcagttgccaggaatgcacttactggaactgcatagcctgggcaacctggaataagggagacaaaacagctgtccttcaaaagggtacggcccctccagactgtcagactaaagcttgtaacccagttaatttcactattttcaattccagtgagcccaaatggaagaagggtttcaaaataagcattcgcattgatggaagaggtcttgaccctggaactgtgctacatttccagagaatcacatttgtactccaagctgcctctcacagggtctttcattccttttatgaagagataagaaacaccccacctcccattccagccacaactaagaacttgttcttagccctggcagaaactattgcacaaactctcaaggtctcctcttgttatgtatgtgggggaacaaacacaggagaccactggcaagccagagaactgaacccataatgagactcataatgagactacatgccccagctcaccaatggggtatggctcttcagaactgctattatagggaaaaattgtcttgtgaggtggggaggatggtttaatgtttcagttggaagcctaacatgtttaggcctaaggttttataatctgactgccccaaagactcaatggtggtcatcctccaacctctcagagcccaagcctaatcccctgtctaacttttcccacctcctacaagcacaggaagatatcagtgctaatatccaatggtgggcaccaaagggattatattggatttgtggaaaaatggcctattccatactctcccccattgggctggggcatgtgtactgggaacaatcagaccttccttcttcctgctcccgctatcactaggggagcaactgggagtgcctatatacagggcacagggtgcccagagagaccagaggtctctccaaattggagactggaaagatgatgaatggcccccagaacagataattcaatattgtgggcctgcccctgggcagaggatggctcttggggatattgcacccctatctatatgctgaaccgcatcatcagactacaggcagttttggaacttataacaaatgacactgtaagggccttgactatattggcccaacaacaaactaaaatgtgcagtgcaatctaccaaaatcgcttggccttggattatttacttgcttctgaaggaggggtttgtggaaaatttaacttaagtaattgctgtctacaaatagatgacactggaaaggtgatagaagaaattgctgaccgcatgactaaactagcccatgtgcctgtacaaacttagaaaggatgggatacagacagtctcttaggtaaatggttctcttggttgggagaaattaagacaatggttggaataatcatggttatactcgcagggtgcctacttattccctgccttgtacctctcctgataaatgttataaaaggttttataagaaccatggttgaaagaaaaacagcctcccacctgctacttatcagaggctaccaaatggttatgactgatgttgatctctaaagggtgcagatgcaccataaacatcaagaggggggaatgaaatagagttttaactaaagaacaacccccccccaccttggctaagacggcagctgcaagcctttccagctattctcatcactataccacccttcttgtaataatgtaacaactgtgtgccctatgtccaagccagcagccttgctaatcatgtacccaacattgcttatcagttctgctttggtaaggttgcttgctcagtttcttagggaggaacactgtctgcttggggatgggcgggggaggtccaggatgcttacatgggaaaatcaagaccttgtagtgtatgaaagttactgagaacaaagacctggtgctcagactctggaggtgactcctctgagcccgcaccagtgctgaataaaccttgcttttccatatctctgactgctgtttgtctccttccactgccacggtttttatggtttctgca

SEQ ID NO: 158 - DNA, 6619 bp, artificial
  ss1284 sequence
tgccttatgtctttgctaccagctctgctagccatggaccaagcatcacttatcagtttcatttttgtaatcttgtttactcagcttcttaggcaggaacactctctgttcagggaagggggggaaggcttcttgcatgggaaaaacaagaccaggaagtctgcattgtataaaatatacccagaaaaaagacttgatgctcagactatggaggtgactcctctgagactgcattgatgctgaataaagccagctattctgcatctctgagagttgtttgtctctttctgttgccaatgtttctgcaacattttctggtgtgttgaccaggaagctgacaaccaaaccggccccttgcgccatttttttctgggaactgggaaaggctatggtttccagcctggtgacagtagatagcacccacctggctgtttctccagatcctaactctcacttgagctgtgctggcctgactcatgccacattccaaacagactaagaaggagaagagaaatgggttccaggatgggatatcagactggtgagtgggctggggacatctgcctgagtctggacccaccctatggcagaaggagagcgatcacctctcagtgaccagaggtcacccaggtcagttgttaccttgggattggatggcctgtcagttctggtgtgcatgtgtgtgagtgactgtagtgaataagagccctgctccatcatcttcagactacagagcctgaatgggtcatcacctgcatttccatggtgacttcatacagactttaaggctataccaggttctgaaggttctcttccctccctgaaagactagtccaggtccaggatttatacacaccagccacatgtgaagaggcaccttaaaccctgagggaggggctgtcaggtggaagaaagtgagtgctcccctactctttgtcttgcaacatcaccacagggtgggaatttacacaatgggtgaattggcttcaaaacccactgtcttagaatgtataattaagaattttgagaaaggattctctggagattatggtataaaactgagctctggagaactgctcactctctgtaccatagaatggccctcctttggggctggatggccctcagaagggaccttagatgtacccacagtttgaggagcatataatgttataacaggggatcctggacacccaggccaatttccatacattgatcaatgatgagaagttgcctagttaaggccagcttgggttcagttctgtatcacagatgagggacagtgcaaagtcctagtatcccagtccaaaaagaaaattctgccttgagaaaaggaaccacctatttttcaagaagaggctgaggactcaccccctgtatcacctccctatgtgctactggtccctccttggggggccaaaagtccccaaatgccagacagcccactgccttaagtttttcctcctcctcctgaagtccccaaggcaatattgcccccacagctgaattcatcataactggtgagcagtcatctccagtcgaaccagggagcagcttccccagtgctacaaatgcccttacaggagatgcagggacctgcagtgtattgcccctgatgggaccatacaagatgggggaccagtcttttataccagcccttttccacaacagacctcctcacctggaagcatcataattcctcatactctgaaaagcctcaggcactgattgacctcttataatccattttacaaactctctaccccacctaagtagacttcccacagctccttctcactttgtttaacaccaaagagtgccaattaatggtaacagaagcccagaaatggctccagaccaatgtcccaggggatcaactagacatggaaaaaactgggcaaggaaagtcttcatggaggagggacctcactgggactacaacactgaagaggggagaaattggaaaagtactgacaggccctcctacagggggtaaagccagggataaaaagtctactaacatggccaagaccactgaggtgctggcactggaaaaaatgaatgccaaaaatgtcctgagagaaggccaaagcagcacacccacttatctggtactaacctgagccatccagcatgaatctgatctgcttaagccaaagcagaatccgactagcagggactgggctctctccaactagggccctgagaacctatggtcagaattcaagtagggagccatcctgaagactttatggtagatatagatgctgaatatttgctggtcacataacccatggccccctctcaggaaaagaaactaccatcatcagggccacaggtcccccaacatggtgctggttaggaggtcatgaggtagtacatgaatttctttacctgaatgactgaccatttcccttgatgggaagagaattgctggctaagatgggggctcaaatctctttctccactgatggatcagctcaactcaaattaatagaaccatcctctcctttaatcatggctctcactgtaagaaagaaagaagagtggtggtgtacccttctcctccagaagaaggggctatttccccagaactagagactgagtacacattggtttgagcagaaataaatgctctgggagtagacaccatgctcctatcttgattgatctgaaacctggatctcaaccagtaaagactgccacaatactcaattcccagagaagcttgcctgggaatccaggctcacctggacaggctacttcagcatgaacttttgataaagtgtcagtcaccctggaacacccccttattgcctgtaaagaaaccagggacaaaaaactacctcctgattcaggacttgggggacataaatgaggtaataaccacattgctcatatatgtgcctaaaccttataccctgatggggctaataccttccactgacaagtggttcatttgcctggacttaaaagatgccttcttctgcctttgaatgggaaaatccacacactgggacaaaggagcagctcatttggtcaaaactcccacaaggattcaagaactctcctacacttttcagtggtgtcctagctgctgacctggatgaattttctggacaaaaagtaaactgtgtcttgctgcattatgttgaagacttcttgctgtccagcaacatgcaggctcaatgcctaaaacctctcctctccataatggaggctgggtatctggtgtcagagaaaaaggcacaaatctgtaagaaacaagtcaaatatctgggctttaatatcatgctgggccaatgaatgttggggactgaaagaaaactgaaaactgatagcagtttgtgctaaccctgtccctaccacccatcagaaagtccaagagtttctaggggcagtgggattctgtaggatatggattcccagttttttagacttggccatatctctatataagacaataaaaagaggagaaaggggtccccttgaatggggaccaagacaggagacacatttcaggcaatcaagaccaaacgcactgaggctctggccttgggacttcttgatgtaaccagagaactcaacctctttgttcatgagaaaaatggaatggatctgggagtcctaacccaataatttagaccttggaaaaggctggtggaatatttgtctaagcaaactgattcagctgctgccagatggacttcctgcctctgagcactggcagctaccaccttattagtaagggaggttgacaaattgactctgggatagaacctcaatgttaaagtcccacattcagttgtaaccctgatgggcaatcagggccaccattggctcacacatgcatgaatgagtcaataccaaggggtactatgtgaaaatccacaggtaaaactggaagttgtacaaaccctgaacccagccaccatcctaccagatgaagtggggcccccagactatgattgcttggaagtactagaggaagtgttttcctgcaggcctgacttaaatgacagactgctccaaaatccagacctgattctatacactgatggcagtagcttcatggagaatgagaaaaggatggcaggatatgctgtggtgtctgactcagaagtgatggaaacagaagtgcttcctcaaggttggtcagcacagagagcagaattatgggcattaatcagagcactagagctcagccaggaccaacgagttaatatctatactgactcatgatatgtctttgcaactccacatgtccacagagccttatataaggagagaggactccttactgctgaaggaaaagtgataaaaaaccatgctgatatctcaaagctcctagaatcagtatgggagcctaaataagtggcagttatctactgcagaggccaccaaaagggaggcaacctggtggcaaaaggaaaccacagcactgatgcagctgccagacaacagcctgggggcaaccgccagacaaacccaaggtcctgctggcctcagaagtgccaactgtccccaaggactctccagaagaagaaaattggataaaagagggaggaggaatcaaaactaagacaggatggtgggttacacatgaccaacagatttatgttccagaacagctggcctataaactagtccactaacaacaagaactgatccacatgggcagaacgtccttagataccttactgggatggtactacctcattacacatcttcctgcactctgctctctctgtttcccaacagtgcataacttgtttacaaaatgatcttctccaggggcctagcagaccagctgggacacaacactgtggactgtccccatttgaggatatgaaagtagacttcactgaagtcaccttgaccaggggatacaaatacctggtagtttttgtctgcaccttttcaggatgggtagaagccttcccaacccaaacggaaaaggcaagagaaataaccaaggcactcatgaaagacatgcctctgacaattgggtcagtcaaaggaatggcatttgtggctgagatagtgcagcatgtggcgaaagccttacagatccaatggaagctacatttggcctattgccctcaaagcttagggaaagtagaacacatgaactgaaccattagcaggctctagttatgttatgtcaggaaactggcttgccctgggtagatatgttgcctgtggccctcctaaaagtgagatgctaaccccgagcagaaataggattctcatcatttgaaatttaatatggaaggctgcctctgctgataagtttgagaggaaacaccagagaattgggagagttagatttacataaacaactgcaaggattggggctcactacctcacagatatacaaattggtcacagatagaatacctatatctttaggcataacagtgcacccccacaaaccaggggggcaggtgtgaataaaagactggaaaaaggagtctttaaagccagtatggataagggccctaaactgtaatctcaactacccccactgctctcaatataacagggataggcacctggatccatcactccagagttaaaccagctggcccaactgatgactgcaggaagtggagagatgcccttggtctggaaaaacccctatgcctggcaatacagaggaggacacaatgatttcaaagccctgctctgaccacaccagaagtttggtctgttaatgcatggatgaaggttgatgaattggctgcccagagatatttgttgtttgtttttattaatctggtcccccttgaccctgtcaggatccattctgatgggtgcagatgcaccctgaacctcaagaggggggaatgaagtaagagttttcactagagaaacaacctccccaactgaggaggcagctacatgcctgacagcaactttgctcaccccaaaccacccttcttgtagtcttgtagcaacgacatgccttgctagtagctctgctagctgagctccaagcattatttatcagttttgtttttgtaatcttgtttacttaactacttaggcaggaacactgtctgcttggggaaggtggggggctgcttgtatgggaaaaacaagaaccagaagtctgtattgtataaaagctacacagaacaaagacttggtgctcagactctggagatgactcctctgagcccacagtggtgctgaataaaccctgctattctatatctctgagtgccatttgtttctttccactgccacagtttctgcaacaataatctttgcactagtgattgtaccaaatggagaaaactctccagagacattcatcatcaatagcatcatcaagatttttcatgttggagttcccatcatggctcagtggttaacgaatctgactaggaaccatgaggttgcaggttcaacccctggccttgctcagtgggttaaggatccagcattgctgtgagccatggtgtaggttgcaaacgcggcttggatcccccattgctgtggctctggtgtaggccagtggctacagctctgattagacccctagcctgggaacctccatatgccatgggagtggccctagaaatggcaaaaagacaaaaaaaaaaaaaaagat

SEQ ID NO: 159 - DNA, 8896 bp, artificial
  ss1288 sequence
tgtcacaagaaatgtttctttgaaaactccatctcttccttctttactttatcccatcttcttgcttggaaaaaaaagtcacagtgctggtaaatggtttaagcttaagaacaaagtcctaaaggcataaatgacttaagcttaagaactgttatgtgcctagaggtcagagtaagagtttaaccttttaccagctaagtggcttttaaaatagtaaaagaacttataaaatagtaaacaaaccctatatctttcacccacagcccctcctcacttgatctcatctaaagagcacaataaaagcagtgtggtttcttgaggcagtgctgttggtccctgagaccttgagtcccctggttcccacctttacttaagataaatgtctctgtgtcttgttttatgttaacttttttccttaagttccacagcacctgttttcttcagccccatcctgctgagctggtcttggcaagtggtgtccaacgtggggcagtctaacaggctaaataacaggcaggcatgaagaaaaaaaggaccatgaccacagtggaatttttattcactggaagtgctgtggagccctgagaagaagggaggaattttgcatggccacgctaaagaaatcctgtggatacattccctctctcaggtgttaacaggttaacatgggaaataaggtaattgcaggaaactatagtccttacatttgtttgttaggacagctctttaaaaaagggggtgcaaaaacaaatgaaagtaagcttttggaaatttttcagactattgagaaacattgtgattggtttcttacattagaaacattatatttaaagatatgggaaatggtaggaatggaacttaggatattgcatgatgagggtgttccaattcctgtgtccatttggagtacttggagcttaattaaattagttttagaacctctacagaccatggaggacttagaggaagaagaaggggaattcaaacttttgttggaggaccctaaatatgcagtccctgaacaaaattatcatagagaatatttggatcctaagctttcagctccaatttttgattctggtatttctcaattgcctcctattaggagtaaggtgacaaggagttattaagcctctacttctagggttgtaaagaaaatgagcactatccctgaacagcatctatcatccattcaacagggaattttacaggcttaaagggaaggtgatttggatgccatacatttagactttccattaactgtcagggagacagtggatccaggcattgatcctgccaaccctgatggagtttatgagttcattcatgagccctttccttttaaaattcttaaagaattaaaacaggccattcaaaactatggtgttaattctccctttacaaaaggaatcatgcagggagtagctgaaggtaattgtatgatttctgctgattggcataacttaaaccgtgttgtgctatcacttagtgaatatttacaatttaagtcttggtggcaagatcatgcccaaattactgctaatcataatcaggcttgaaatcttctgattacaatggaataattgttaaggattggtcattggagtaatcctcaagatcaaatgagaattgaatgatttgggtattgaacagattagacaatgttgtttaatggcatgggataaaatttaatctaaggatcaaataaatacttcttttcaaaagatcctacaaggccctaaggaatcttatactgaatttctagctcacttacaagaggaattaaaatgacaaattactaactctgaggtgtctgatactatttttcaattgttagcatatgaaaatgcaaatgctgattgcaaaaaggcaataggatttttaaaaggaaaagctaacattgccaaatatattaaagcctgtcaggaatcctttaaggcctcaatgctagcacaagcagtggctagtttaaaggttaaagacaaattttcaaaaaaatgttttaattgtggtaagacaggacatactaaaaaacaatgtcgtgttcctccacgaggctgacctttctttcacagagctttggcaccttctagtaacaataataaacagcccagactatgtccaagatgtaataaaggaaatcactggtctgaccattgccagtccatctttcacaaagatggactcccccttgtcaggaaactacccttgtactactactactacagggcaagcttccagccccatcaaccaaggaatatttccctattcagagcaagagtcaaactctcaactaatgtgagattcccagggactatgctctgcatgagtgttcaacatcacagtagatatccctagtttacaggatttaattatccttcctagtgaaactcctacttctattacaactaaattggaaaaaccattattggcagatactgtaggatttgtagtaggaagggcagggctaacagaacaaggagtttgagttcatactgggatattggataatacaggggatgataaagtacaagtgatggtttccactgtgattccttgaaaattgaaaaaggggatcagattgctcaaatcttaattttacctagagcacagtagaaaaaagagaggaataattttagacagaagggattcaataccacaggaggggcaggagtgtttttatcagaaaaggtcccagaggaatgacccacttgtcaagttatcataaatgggaagtcttctagaggattgattgatactagggctgatgtttcaatcattagccatttacattggccagacacctggcctcttcagccagccgatattgaagtcactgggttaggaaaagcagagggtctcaaaaagagtgcccaatggcttaattgtgaaggaccagatgggcagccagctatattgaaaccttatgttgctcaactccatatcaatctatgggggagagatttattacaacagtggcatgcagaaatttacatccatatagatccatatagtcatcaaagccaaaaaatgttacagaaagagggttacattcccagactggggttagggtgacattatcaggggagagtggaacctgtcaaatctgagattaaaatggacaaatctggtttgggacatcggccttttcattagtggccactgcttgtaaaaataattatgcttttcctgaatctattcaattaaaatagactacagaaaaaccagtttgggttgagcagtggcctctccagaaaaattaaaggttttaaatgatctcatccaagaacgattagagaagggccatgtagaagaatcctttagtccttggaattcgccagtgtttgttatacagaaaaaaatcaggaaaatggagattgttaacagatttaagtggagcaaatgctgtaattcagactatgggtgcccttcaaccaggcctcccatctcctagtattataccagctgactggctgttaattatcctggacttaaaagactgctttttcacaattctttacacccagggaaaaatttgctttttcagtgccagtggtaaacaatatggcccctagaaagtgttatcaatggaaggtcctgcctcaaggtatgttaaatttccctaccttgtgtcagtattatgtggcttcagttgttgagccagtctgaagacaatttcctaaatgctatattgttcattatatggatgatatactttgtgctgcaccctctcgggagtggctggctgaggtttttcaatgcttgcaatcctgtctaaaaggagcaggaatgattattgctcctgaaaatattcaaatgaaaagtccatatcaatatctgggaactgtagttaaacataccactgttcatcttcaaaaggtagaattgagaagagatcaaatttctacattaaatgatttacaaaaactgttaggagatattaattggctctgaccttgtttgtcaaatcttttctccttacttaggggagattctaaattaaacagcccccactctctaactgcagaagcagaagaggaactaaaaaagattgaaggtaaaatacaaaactttcaactaagttgggtcaatctaaaacagcccattcagttagtaattataccttctcctcattctcccatgggaatattgatgcaattagaaaacattcttgagtggctttttcttcccaataatgtcacaatgtctttgtcttacctggaccttatggcacaacttattctaaaaagtcatactcattgtgtacaaatgtctggaaaatatttgaatcatgtaattgctagtttaactgttaaggaaatccaaaattgttttcaaaaccatataggttggcaaattgcctttgcagattatgtaggatcaatagataatcattatccaaaaaaacctattttacaatttataaagaaaactcaatggattctgccaaaaaagttgaaagattcacccatcattgaagccctgtgatctttactgatgggattagtaaagggaaggccagatatgtggctaatcaatataaaattatagaaacacatggcctttccacccaacaggctgaagtaactgttgtaatccatgccttgagggattatcctgagccaatcaatattctttctaattaggcatatgtagttcatactgccaaaatgattgaaactgctaccattaaacaaaatctacctatcttgttatttgacttgtttacagaattaaaaactgtgtaagggaaaaaagatatccattttatattacccatatcagagcacatactaacctacctgggcccctagttgcaggaaataaagaaattaaccacttgatgacacctgtgttacaagaagctcaacattttcatgatttaacacatgttcgaggccttaaaaagagatttggaacaacatgggctaaagctaagacaattgtctgtcaatgtcctccatgtcaaattattaacaatccttctcaatctgagcctggagttaaccctatgggacttgtcccaaatgctctctggcaaatggatgttactcattattcatcttttagaaaattgtcatttattcatgtatgtattgacacttactctaaatttatttgagctactgctcaatctggtgaatctgctaaacatgttattcatcatttatatgcctattttgcagatatgggcctgccacaagcaattaaaactgataatggcccagcttatatcagttctcaacttaaaatattcctggacacatggcatattgctcactctactggtctcccttacaacccccaaggacaggctattgtgcaatgagccaatttatatgtaaaacaggctcttcaaaaacaaaaagggggagacacagaaatagttaattcacaacaaacacttgtaaataaaaccttactcactttaaatttttaaaatttggcctctgatgaaaaaatggctggagagacattttaattcagaacaaaataagattaactttcctcaagctgaacagcccttgatttggtggcaggatccattaacaaacttctgatctctgggaaaacttattacaggaaaacctgtcacgtggggtggggatatgcttgtatttcaccaggtcatggattacaacctgtttggattccatcaagaagaatcaaaccatatcatgagcaagcccatgaagcatccctcaactccagaccccagaaggaggatgataaggcctcatctttccatttggggtcagatcaatcatctatcccaagaagatgaaaatctactaagaagagaaggaaagcctctcactccaaataatttggccctagctctctttactttggtttctattgcagtgagtattctcacattggcatagaaatcattttattacttgtatagtagagggattaaaaacctcatgagtaaagccagttaaaaactatcagaggtttactaggggaacaagagagtccatcagctttcttagaaagactcagaaaggcattaagaaaacatacaaaggaacccagaaacaatggaggactgaataataaaggataaattcatagctcaattggtgccagatatatggagcaagttccaaaaattgtcttttggccctgttcaggacctggagcacctcctcagagtagcaactcaagtatgttataatcagggccacgaagaatgaaaggagaacaagaagagagacagggaaaaggctgaggtgctatagggagtcaacctgggagtttccaaggtgagaagactagggcagagacctatgcacggagcccatttcctctgtggaaaagagggatcctttaaatgggaatgcccctagacacagctgtgccccatatgttggggacatcactggaagagggactgcccccgaagatgaaggtctctgtgcttgacccctcaggcccaggatcaagactggcaggacatctccataatggctcctgtccttatcactactcaggagtcctgggtgactctaaatgtaggaagacagcctattgacttcctcctgaatacagagccacttttcagtcctcctctccaatcctgggcccctccctcatgaatctaccacattcatatttctggcaagccagttataaaattctttacacaacctttgagttgtgactgggaatccattttcttttctcaatacctttctggttgtttcagagtccaactcctcttttagaaagagattttatgagaagttaaagcctcaatgcacatgcaaatggagcctaatcaaggtttatgcctgctttcaatggactagatttaaaagatgcctttattctgcatttccttgactaaggctttgcatatacaaattcttaaaatatggaaggtaactaactggctagaattaattttaggttcaagtaaactgggaaatattcagtattaaattaatatcttaaattagaattgaagtttgctaatctaatacatacatgccattacagctgtcaacattaggtgtaatatcttatcgtaagtaggtttaacagaagtgaaatgagacactgagatatcaattactaaaaaactaaatttatttagaatgattaatcaatatgatcagtgccaccctgagatggtctctataagaaaaacatgtgtttttagaaattataaaggacagtccatggttacttgagaaaagtagaatgtgtgtgttttcaatatagaaggaatgaggaagggaatttcatcttattaaagcaaaagaaagattgtcttcagctgattggtctggttggaaaataagggacagactaatatggatacagaacgtgatacaatgtgtgtgggaagtggacactgagaagagaattttgtgcatggtggggactgtttagaatatatttgagtaagttaactttaaaagtaaggtggtgccataaatcaaactgttcacaaggacataaggtagctttcaattacatgctgaccaaggcatacatatatttcataaccagccagagaaatcagaaagatcatatgagttacctgtgctattataaaatctaaaatcttgtattcctgattgttctcagaatgtggctaattacctgctagatcttcaaaagtagattcatgagctgtcctgtctagctccagcttttggagctgccctgtggaaccagctgacctccttctcctggtgaaaatatttattcaccatattcattgtggtcctgatcctttaattatcattaattgtatttcttgcttcattacatcctgattaaaagttatcaatgttcaaatgttgatagaagggtacccaaagcaatgtatcaaagcccacttgaccccaatgagtggaggcctaactgctttccctagtgatgccccttttcatcaggaagaagtcagagtggtcatcagcccttttcctcacagttagagtctccaactcggagggaggattgaggcagaatattaactcagttagtcagtgtagggatatgggcttcattctttgatgtggctattgattaacatttgtaaactgaaggtcgcatggcaaccccaactgctatgaaggttgcgggtattgctccatggatccatcacatcagagtcaagaaggctgcatctactgctgacatggacacaagagaggctgtatagcaccttgagaatcccctcatggtcaagttccagagactccattcaccatcgtcagagaactctaagtcctgctctggccaccccggaagctggtcagtctacggcagaagcctgaggagttccacatgatacttaacttggactcatgttctgtctatagatgtaagaagtgagtaatccaagaagaaatgaaaaagttgcaagatctatttttgtctccccacaaaaacaaaaagggggagaggtcacaagacatgtttctttgaaaactccatctcttccttctttactttatcccatcttcttgcttggaaaaaaaagtcacagtgctggtaaatggtttaagcttaagaacaaagtcctaaaggcataaatgacttaagcttaagaactgttatgtgcctagaggtcagagtaagagtttaaccttttaccagctaagtggcttttaaaatagtaaaagaacttataaaatagtaaacaaaccctatatccttcacccacagcccctcctcacttgatctcatctaaagagcacaataaaagcagtgtggtttcttgaggcagtgctgttggtccctgagaccttgagtcccctggttcccacctttacttaagataaatgtctctgtgtcttgttttatgttaacttttttccttaagttccacagcacctgttttcttcagccccatcctcttgagctggtcttggca

SEQ ID NO: 160 - DNA, 7512 bp, artificial
  ss1291 sequence
tgccctatgtccaagccagcagccctgctacacatgtacccaacattgcttatcagttctgcttctgtacctttgcttgttcagtttcttagggaggaacactgtctgcttggggatgggggggtggaggtcccagatgtttacatgggaaaatcaagaccttgtagtgtataaaagttattgagaacaaagacctggtgctcagactctggcggtgactcctctgagcccacactggtgctgaataaaccttgattttccatatctcctagtgctgtttgtctccttccactgccatggtttttgtggtttctgcaacatttttggtgcattggccaggaagccaacaactgagctggcctcttgtgccaccattgtcggggaaccgggggaggccacggtcacaccttggctcacaccgcatcctgaatggactcagaaggggagtggaaacaggttccaggacaggacgtaggactggtgagtaccccagggacatctgcccgagttaggacccaccatacagtgaaaggagagactgacaacctctcagtgaccaaagggtcactcaggtcaggatttgctcccttgggattgagagtcttgtcaattatggtgtgtgtgtgtgtgtgtgtgtgtgtgtgtgtgtgtgtgtgtgtgtgtgtgtgtgactggagagaatgagagcccgtgttccaccgtctttggactacggagccagagtgagtcctaacctgcagttccgcagtgacactcatatgtcttatggtggccctcttcagagggatcctgacattggggtttatacagtcccacctatgctaagaggtgcctgaaatatcccctttgggggagcggtcaggcagatgaagtgattgttacctgaggccttgtcctcactgtttgtcttgtgtcaccgtcacagggtgggacttcacacaatgggtaaatcagcttccaagcccactgtcttagagtgtatggttaagaattttaagaaaggattttctagagattatggtgttaaactgagtcctggaaaactgtgtacactctaccctagagtggccttcctttggtgttggctggcctccggaagggaccttagatgtgttcacagttgcagcagtatataacgttataacaggagaccctggacacccagaccaatttctgtatattgatcaatgattggaaattgcctatttgaggcccccacagttttggttctgcaccacagaccagagacagtgtagggtgctagtagcccagtccaagaagaaaaaaaaggtgccacctgtttttcaaggtgaaccagaggacttgccccctatgccaccaccttatgtgctgccgtcctcacctctgagagctgaaggtccccagatgccagatagcccactaccttctgtttctcctcctccttctgcttctgaaattcccgaggcaatatcactcctgccgccagattcttcagaaccaatgagcaggtgtcttcagtcagctcagggagcagccactccagctttgcaaatgcccttatgggagacacagggaccatggcaagtcacccctgatgcgaccatacaagagggggaatgggttttttattatcagcccttttccactgccaatctcctcaactggaaacaccatattccctcatattctgaaaagcctcaggtgctgattgatctcttagaattcattttccagacacactgttccacctggatagactgctggaaactcctttttactctgtttgacactgaagagggctggcgaattgtaacagaatcccaaaaatggcttcaggccaatgaggggggggcaagcagacttggcaaactgggtaagggcagctttcccagaagaaaacccccactgggattatgacactgaagaagggaaatgtaacctagagaggtactggcaggccttcctacagggggcaaaagctgggcctaaaaggcctactaatatagctaagaccagtgatatactacaagagccgaatgaaagcccagccaaattctatgagagactatgtgaggctttccgaatctacaccccttttgatcccgaggcccctgagaaccaacggatgataaatgccacctttgtgggacaagcccaatcagatatccataaaaagctacagaaattaaaaggatttgcaggaaagaatgctactaaactgttggaaatagccaacaaggttttcattaaccaagaccaggtggcccaccatgatgcagaaaagagaataaaacaaaaagtgactcttctggtggccaccctgtcaaaactggtgcccccaatggaatcaccccagagggaacaagacccaaggccagggaaaaggaatcccctggaacatgatcaatgtgcttactacaaagaaaagggacattggaaaattgaatgccccaaccatcctgagaaaaagaccaaggccccacctagctggtaccaacctgagccattcagcaccaacattatcggcctagctgagtctgattaggggggaccaggctctctccaactgggcccctgagagcctatggtcagaattcaagtagggggccaccccattgactttattgttgacacaggtgctgaactttctgtggtcatgcaacctgtagattccctctcagggaaagaaaccaccatcattggggccacaggtaaccaaacccacaggcccttctgcagtccttgatgatgtcagttaggaggccatgaagtaatacatgaatttctttacctgcctaactgcccagtccccctgatgggaagagacctgctggctaaaatgggggcacaaatttccttttctactgatggattggcctaactcaaattgacagaacccccctctcctttactcatggcgcttgctgtaaaaagggaagaggaatggcgcttgtactcttcccctttggaaattgggaccattctcccagaactagagactaaatacccattggtttgggctgaaggaaacccaccaagactggcaaaatgccatgctcctgtcttgattgatctaaaacccggagctcaactggtaaatctacagcaatactcaattcccacagaagctcatcctggaatccaggttcacctggataggctgcttcagcatggactgttaataaaatgtcagtccccttggaacacccctttattgcccgtaaaaaaaaaacaggaacacaagtctaccacccagttcaggacttgagagccataaatgaagcaacagtcacattacacctgtctgtccctaacccgtatacattgctagggctgataccctccactgctgagtggtttacttgcctggacttaaaagacggctttttctgcctctgggtggtgcctgccagtgagcccttgtttgcttttgaatgggaaaatccacatacagggacaaaggaacagctcacctggactagactcccacaaggattcaaaaactctcccactctttttagcagcaccctagccactgacctggctgaatttcctggacaaaaactgggctgtgttttgctacagtatgttgatgacctcttactagctggcaccacggaggctcagtgcctagagtgaacaagagctctcctttccctactgatggaggcggggtatcgggtatcaaagataaatgcacaaatctgtaaaaaacaagtcaagtatctgagctttaacatcatgtagggccgatgaatgctggggactgaaagaaagcaggtagtttgtgccattcctgtccctaccaccagccggaaggtttgtgagttcctaggggcagcaggattctgctggatatggatccctgggttttcagacttggccaggcctctgtatgaggctctaaaaggggaagaaaaagctccccttaaatgggaaccaagccaggaggcaacatgtcagacaatcaaaaccaaactcactgaggctccagccttgggacttcctgatgtaaccagaggattttttgttcatgagaaaaatgggacagtgggtcacacgggatcaccgagtttatgttccagaacagctggcctacaaactagtccaccaacaacacgagttaacccacatgggcaaaactgtcttagagaccctactgggccggtattatctcattgcttgtcttcctgcactctgctcctctgtctcccaaagatgcataacctgtttgtagaaaaatgcctaccaggggcccaacagaccagttggggcacaacactgtagactgtccccatttgaggatatggaagtggatttcactgaggttacccctactaaggtgtacaaatgtttactagtttttatctgtactttttcaggatgggtagaagccttccctacctgaactgaaaaagcaaggaaagtaaccaagacactcctgagagacattattcccagatatggaatgcctctgaccatcaggtcagataacagacaggcatttgtggctgaaacagtacaacaggtggcaaaagctttacagagctgatggaaactaccttctgcttattgccctcaaagttcagggaaagtagaatgcatgaactggacccttaaacagacactggcaaagttatgtcaggaaaactggtttgccctgggtagacatgttgccggtggccctcctaaaagtaagatgttcaccctgagcaggaataggattcgcgccatttgaaatcttatatgggaggccacctccactaatcagtttaaaaggaattcgcagggagttgggagacttggaattacataaacaattactaggactgggcccactatttctcagatacataaatgggtcacagaccaaatacctgtgtccttaggtataacagtacacccccacaagccaggggaccaggtgtggataaaggactggagaaaggagccagcatggaagggcccctatactgtaattctaaccaccctcactgctcttaaagtaacaggaatagatgcttggatacatcattccagagttaaaccggctggcccagctgatgaccgtggagagtgggagactgccctcgagccggagaaaccttgtcgcctgacaatacagaggaggagatgatgatcttaaagccctattctgaccacaccagaagctggtcagtcaacgcatggctgaagcttgaggaatcggctgcctggtaaaataaactgccttacctacattccacaagagactttcttactgttatgtactatcttatatccaacatgtatgtttgctgcctgttgctgttaatctggtcccctttggttctgccaggatccatttcctgtgacccatgcattcaagtgacccgatcagatcaaggggttacatggactttgctttactccactcatttctcctgttccagagaaattcacagaagttgtactcacaacaggaccacttattctgtcaacagggggccaatatacttgctttgatcccacaatactcaccaactgaggaatggttagaagtccggcattctcataaatcagggcagataattaattggacccaaattaccaaccccaagttgccagtctcaatgctttttgatgcctgtgaagctatgaatgggtcatgggcttccacaagaccatgtggaagcctgtcatgggaaagagaatataggctccagcataaatatatgtgctgggggaccaccagcagcagttgccaggaatgcacttttactggagctgtgtggcctgggcaacctggaataagggagacaaaacagctgtccttcaaaagggtacagcccctccagactgtcagactaaagcttgtagcccagttaatttcactattttaaattccattgagcccaaatggaaggagggtttcaaaataagcatttgaattgacggaagaggccttgaccctggagctgtgctacatttctagagaatcacatttgcactccaagctgcctctcacagggtctttcattccttttatgaagagatgagaaacactccacctcccattctggccacaaataagaacttgtttttagccctggcagaaactattgcacaaactctcaaggtctcctgttatgtatgcaggggaccaaacacaggagaccactggccttggcaagccagagaactggacccattagagcctcataataagactgcatacccccaattcaccaatggggtatggctcctcagaactgctattttagggagaaattttcttgtgaggcggggaggatggtttaatgtttcagttggaagcctaacatttttaaggcctaaggtattataatatgactgcccaaaagactcaatggtggtcatcttccaacctctcagagcccaagcctaatcccctgtctaacttttcccacctccaacaagcatgggaagatatcagtgctcatatccaatggcgggcaccaaagggattatattggatttgtgaaaaaatggcctattccatactaccccccaattgggctggagcatgtgtactgggaacaatcagaactcccatttgctgccactgtcactaggggagcaactgggagttcctatacatagggcacagcttgcccagagagaccagagaactctccaaattggggctggaaagatgatgaatggcccccagaatggataattcaatattatgggcctgccacctgggcagaggatggctcttggggatattgcacccctatctatatgctcaaccacatcatcagactacaggcagttttggaacttataacaaaagacactgcaagggccttgactgtattggcccaacaacaaactaaaatgtacagtgcaatctaccaaaatcacttggccttggattatttacttgcttctgaaggaggagtttgtggaaaatttaacttaagtaattgctgtccacaaatagatgacactggaaaggtgatagaagaaattgctgaccgtatgactaaacttgcccatgtgcctgtacaaacttggaaaggatgggatgcagacagtctctttggtaaatggttctcttggttggggggaattaagacaatggtcggaataatcatggttatacttgtagggtgcctacttgttccctgccttgtacctctcctgataaatattataaaaagttttataagaaccatggttgaaagaaaaatagcctcccacctaatacttatcagaggctaccaaagggtcatgactgatgatgatctctaaagggtgcagatgcaccctgaacatcaagaggggggaatgaaatatagttttaactaaagaacaacccccccttggctaagaaggcagcctcaacccttttcagctatgctcatcactataccacccttcttgtaataatgtaacaactgtgtgccctatgtccaagccagcagccctgctacacatgtacccaacattgcttatcagttctgcttctgtacctttgcttgttcagtttcttagggaggaaca

SEQ ID NO: 161 - DNA, 5566 bp, artificial
  ss1293 sequence
tgggggctcgcctgggatttggggtccactggactgtggactctcgaggaggggagacatgtcccacggccctgttgtggtggccttgaattgagaagtccgcatctgtgaactccaaacccgtggagggttcgtgacaacacgggaaatcatgcaatgaccaggcaacttccattaatggaccaaggtaggaaaatccttggtggtcggggaagggggtccataagtctcaaaggtctcgggtgaggccagcgattttgggtgaaatcataaaatcagagtacaaccctcaaaggccttgggtgaggctggtggcctcgggtgaggctggtgactttgggtgaaatcagaggatcaaaacgtgatcctgggaaatgggaagtaagtcttcccgacttgtacctctacttggaggatcaaatgggggggaccaaattccttcagacaatcctctgggactaccgttaaagtattggggtgacagtccatggacaaaagacaaaaagaagggaaaaatgattaagtattgctgttttatctggacacagacacctgtccttgccacatccgtcttctgaccaaagatcggattggacaaggattgggtctgtcagatgcctattcaatttgtccagaacaagacaccagggtcccaggaagaaactgattatgctctctgttggtggcagggaccggtggtcttatttcccctcagagcatgggataagaaggaaaaagaggaggaaacccaagaacaatcggggacttcctcccctccatgggaccccttggcttgctgctgccacctcacatccccaaaatggtgctggatcccctccagctgcagctgccactgccgggggagcacaagagggggaggggtgcagagcccatcatgcaggtgcaagggcactgcctcaggccatgaattagcacagagggggagggccacagagcccatcatgcaggtgcaagtgtgctgcccccactagctgagtcagagcaggaaggggaggagcctagagcccaccaggcaggcacatgtgcactgccactgttcagggagtcagaacaggatgggggcgccacagccatagacatactgccacagccagtgggatcaaagcccagcacctcaacaaaaccagaggatatggcagggccttattccagacttaggagagagttaaagcaatgtcaggaggatattcaaaattttccttttcccactgctacccctggggatagacaagaagggccacaaatgctcttcccactatgggaggtttgcttaagtgggggagaaataggatatgtaaatgcccctttaaccagcactgaggtccgaaattgcaaccatcgctagaagacccatacggggtagcagataaactagatcaattccttggaccacaagtctatacatggtctgaattaatgtctattttgagcattctgttctctggagaagaaaaggggatgatttgaaggtcagccatggccttgtgggagtgaacccatcctcctcaaccggaggaagttagggcagaaacaaaatttcccaacaaggaccctggatgtgacaataacaatgtagtccaccgggggcatatggtggacttgagaaatctaataattcagggaattagggatgccatacctcaaactcaaaatatatctaaggcatttgaggtgtggcaaggtaaagaggagggaccaactgaatttttgggaagactcagaattcagatgagaagatacggtggaatagattccaccaaccctctgggacagggcaagctcaaacttcacttcataactagtagttggccagatatttccaagaagttacaaaaaatagaggcttggaaagataaaccattagaggacctattaaaagaggcacaaaaggtttatgtgagaagggatgaggaaaagcaagagcaaaggaccaagatcatgtttgcatatcaacaaaaacaagacagattaaatcaaagaggtcctaaagccaaaagtaagagacggtcgcaatatcggcctcaccgctatccagaaacaggatgtaagggaaaggggaatagatggcaaggtgaaaacaagtgctttaggtgtggcaaattgggacatttcaaaaggaagtgccctgagtggaaaaaggaggagaaaacaatccctctcatattatttgaggaaaatgaggactaggggtgtcaggggctcttagtagtgattgaccaacttaaaaatccacaaatgccctacccagagcccttgataaatttagaggtagggtcataccatgaaactatgatttttcttattgattcaggggcgtctcgctccttgctttgttacttgcccaaagggtgttcttcttcacgtgaacaaatattagtatctggagtaaaaggggagggattctctgcaaacattttagaagaaaccaaagtaaatttccaaaacagatgtgccagaatatgtttcctttttgttccagagaccagcacacatctatgtggaagagacctaatgaccaaattgggattgggtttacagattaccaaaaaaactttacaagtaaaactaaatcttttaaccccaacagtggagggacaaattcaaccacaagtgtgggcatcagagggaaattgtgggggactcaaagtgacccctattaaaacacagttaaaaaatccctggagaagtagtctggagaaaacaatactctacaaggaagggtgggacttaaaccaattatagagggactactttaagagggtctcttagaaccctgcgtgtcttcctataaaacccctattctccctgtgcataaggtggatgggtcctatggcttagtccaggatttgcgggcaattaaccagattgttaaacatccagtagtcccaaatccctataccctcctgagtaaaattccatttgaccaccaatggttcagtgtaattgatttaaaagatgccttttgggcatgccccatggactcagagagttgggacctattcgcctttgaataggaggacccagtaactggaagaagacaacaatgtagatggacagccctcccccaggtgtttggagactccccacatcttttcaggcaaattttagaacaggtgttgggagactttacaccccctcatgggacctgcctactccaatgtgtagatgacttgttacaatcaaacactgatcaaaagaaacttacagcagctacactttcccttcccaatttccttggggaacaaggccttagggtctccaaaaaaaaagttatagtttgttgaaaaggaggtgaaatacttaggacatctaataactgggggtaagagaaaactcagcccagaaagaatagaggggtatcataggcctgcctctttcaaccaccaaacatgaacttagaaaattcctaggcccaattggatattattgcctttggatcaactcttatgcattaaaaactaaaaatctatattctaaacttgtgtaggaaggccctgacctcctactatggagccaggaggaaatacaacaattcagggatctgagggaggtactgatgggtgcccctgttctggctctaccatcctttgaaaaaccttttcatttatttgtaagtgtggacaggggaatggctccaggggtccccacgcaggaacatgggggaagtcgccagccggtggcctttctttcccacctcctagctcctgtcaccagaggatggcctgagtacatacagtcagtagctgccaccaccctcttaactgaagagagcaggaaactcacctttggaggaaggctaactgtgagtaccccacaccaggtatgagccatcctaaaccaaagggtagggagatggctcactgactcctgagttttaaaatatgaggcaatcttattggaaagggatgacttaaccttaaaccctgcttctttcctcactcaaaggaagccctcaattcccatcgaacatcatggtttaaatttaatagactatcagaccaaagcttgacccaatctatgggaaactcccttccgttcagggagacatttattcactgatggatcttctcgggtcttccagggaaaaacacacaatggttattcagtcattgatggagagactcaatccatcactgagtgaggaagactcccaaatgcatggtcagctcaaacttgtgaactctttgcccttaaccaagccttaagatatttaaaaggaaaggagggcacaatctatactgactctaaatatgcctttggagtggtccatacctttgaaaaatttggatggaaaggggacttattaacagtaaaggacagggactaatacatgaggacttgattaaacaagtacttaatattatctccagctcccagaagagatagcagtggtatatgtgccaggtcaccggaaggggacctcgtttgaagcccgaggaatctccttagcagatgaggaagccaagagggtggcattagaattgggggttcctatcttccatcttactccctcccttcccaaaataatgatctctccctccttttcagaaaaagagaaggaacaactacaacagctgggggcccaacttgacgctcagggaagatggtttctcccagatgggagggaaatgcttatgagagaaattctgacacacctacaccaaggaagccattggggacctcaggccatgtgcgacacagtcttaggggcctatgggtgtgccagtatctacacaatggccaaacaggtaatagaaggttcttaacatgcaaaaagaccaataaaagggctttacaaaaaacagctaccggaggaaggtctcctggtttaagccctttccagagtatccagattgattacaccgaaatgcccaaaatagggagacttaaatacctcttagtcatagtagaccatctaactcattgggtggaggccaccccattactcagtgctactgtcaattatgtgacaaaggccttattagaacaaattattccccaatttgggatggttgaaaacatagattcggagaatggaagtcattttacagctcagataacaaagggactctccagagaattagatattaaatggctatgccacaccccatggcatcctccctcttctggtcgaattgagagaatgaaccaaactctcaaagctcatttaactaagttaatattggaaacccagctaccctggaccaaatacctccctattgctttacttagaattagaactgctccccgaaaggatgtcagtctatctctatatgaaatgttatatgggtttccttacctgggtagatcatctgacctgcctacctttgaaaccaaagaccaatttttaaggagttatgtatttggtttatccttctcccttcattttctcagacagaagggattactagcccaggctctaccgcatgatttcctggtccattcacagcagcctggagactatgttctaatcaagtcatggaaagaagacaaactccagccaacctgagagggacctttcctcgtgttgctgattaccaaaact

SEQ ID NO: 162 - DNA, 8364 bp, artificial
  ss1297 sequence
tgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgacagccctagtgacctatctcaactgcaatctgtcactctgcccaggagcccacgcagatgcggacctccggagctattttaaaatgattggtccacggagcgcgggctctcgatattttaagatgattggtccacggagcgcgggctctcaatattttaaaatgattggtttgtgacacacaggctttgttgtgaaccccataaaagctgtcccgattccgcactcggggccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgagggggattgttcttatactggcctttcatttggtgcgttggccgggaactcctgcgaccaccccttacacccgagaaccgacttggaggtaaagggatcccctttggaacgtgtgtgtgtgtcggccggcgtctctgttctgagtgtctgttttcggtgatgcgcactttcggtttgcagctgtcctctcagaccgtaaggactggaggactgtgatcagcagacgtgctaggaggatcacaggctgccgccctgggggacgccctgggaggtggggagagccagggacgcctggtggtctcctactgtcggtcagaggaccgagttctgttgttgaagcgaaagcttccccctccgcggccgtccgactcttttgcctgcttgtggaagacgcggacgggtcgcgtgtgtctggatctgttggtttctgtttcgtgtgtctttgtcttgtgtgtccttgtctacagttttaatatgggacagacagtgacgaccccccttagtttgactctcgaccattggactgaagttagatccagggctcataatttgtcagttcaggttaagaagggaccttggcagacttccggtgcctctgaatggccaacattcgatgttggatggccatcagaggggacttttaattctgaaattatcctggctgttaaagcaatcatttttcagactggacccggctctcatcctgatcaggagccctatatccttacgtggcaagatttggcagaagatcctccgccatgggttaaaccatggctaaataaaccaagaaagccaggtccccgaatcctggctcttggagagaaaaacaaacattcggccgaaaaagtcgagccctctcctcgtatctaccccgagatcgaggagccgccgacttggccggaaccccaacctgttcccccacccccttatccagcacagggtgctgtgaggggaccctctgcccctcctggagctccggtggtggagggacctgctgccgggactcggagccggagaggcgccaccccggagcgggcagacgagatcgcgatattaccgctgcgcacctatggccctcccatgccggggggccaattgcagcccctccagtattggcccttttcttctgcagatctctataattggaaaactaaccatccccctttctcagaggatccccaacgcctcacggggttggtggagtcccttatgttctctcaccagcctacttgggatgattgtcaacagctgctgcagacactcttcacaaccgaggagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaatttggctaaggtaagagaggtgatgcagggaccgaacgaacctccctcggtatttcttgagaggctcatggaagccttcaggcggttcaccccttttgatcctacctcggaggcccagaaagcctcagtggccctggccttcattgggcagtcggctctggatatcagaaagaaacttcagagactggaagggttacaggaggctgagttacgtgatctagtgagagaggcagagaaggtgtattacagaagggagacagaagaggagaaggaacagagaaaagaaaaggagagagaagaaagggaggaaagacgtgatagacggcaagagaagaatttgactaagatcttggccgcagtggttgaagggaagagcagcagggagagagagagagattttaggaaaattaggtcaggccctagacagtcagggaacctgggcaataggaccccactcgacaaggaccagtgtgcgtattgtaaagaaaaaggacactgggcaaggaactgccccaagaagggaaacaaaggaccgaaggtcctagctctagaagaagataaagattaggggagacggggttcggaccccctccccgagcccagggtaactttgaaggtggaggggcaaccagttgagttcctggttgataccggagcggagcattcagtgctgctacaaccattaggaaaactaaaagaaaaaaaatcctgggtgatgggtgccacagggcaacggcagtatccatggactacccgaagaaccgttgacttgggagtgggacgggtaacccactcgtttctggtcatccctgagtgcccactaccccttctaggtagagacttactgaccaagatgggagctcaaatttcttttgaacaaggaagaccagaagtgtctgtgaataacaaacccatcactgtgttgaccctccaattagatgatgaatatcgactatattctccccaggtaaagcctgatcaagatatacagtcctggttggagcagtttccccaagcctggacagaaaccgcagggatgggtttggcaaagcaagttcccccacaggttattcagctgaaggccagtgctacaccagtatcagtcagacagtaccccttgagtagagaggctcgagaaggaatttggccgcatgttcaaagattaatccaacagggcatcctagttcctgtccaatccccttggaatactcccctgctaccggttaggaagcctgggaccaatgattatcgaccagtacaggacttgagagaggtcaataaaagggtgcaggacatacacccaacggtcccgaacccttataacctcttgagcgccctcccgcctgaacggaactggtacacagtattggacttaaaagatgccttcttctgcctgagattacaccccactagccaaccactttttgccttcgaatggagagatccaggtacgggaagaaccgggcagctcacctggacccgactgccccaagggttcaagaactccccgaccatctttgacgaagccctacacagggacctggccaacttcaggatccaataccctcaggtgaccctcctccagtacgtggatgacctgcttctggcgggagccaccaaacaggactgcttagaaggtacgaaggcactactgctggaattgtctgacctaggctacagagcctctgctaagaaggcccagatttgcaggagagaggtaacatacttggggtacagtttgcggggcgggcagcgatggctgacggaggcacggaagaaaactgtagtccagataccggccccaaccacagccaaacaagtgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccgaggagttttaacccaaaccctaggaccatggaggagacctgttgcctacctgtcaaagaagcttgatcctgtagccagtggttggcccgtatgcctgaaggctatcgcagctgtggccatactggtcaaggacgctgacaaattgactttgggacagaatataactgtaatagccccccatgcattggagaacatcgttcggcagcccccagaccgatggatgaccaacgcccgcatgacccactatcaaagcctgcttctcacagagagggtcactttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaggatggctggggcggcggtggtggacgggacccgcacgatctgggccagcagcctgccggaaggaacttcagcgcaaaaggctgagctcatggccctcacgcaagctttgcggctggccgaagggaaatccataaacatttatacggacagcaggtatgcctttgcgactgcacacgtacacggggccatctataaacaaagggggttgcttacctcagcagggagggaaataaagaacaaagaggaaattctaagcctattagaagccttacatttgccaaaaaggctagctattatacactgtcctggacatcagaaagccaaagatctcatatctagagggaaccagatggctgaccgggttgccaagcaggcagcccaggctgttaaccttctgcctataatacaaacgcccaaagccccagaacccagacgacagtacaccatagaagactggcaagagataaaaaagatagaccagttctctgagactccggaggggacctgctatacctcatatgggaaggaaatcctgccccacaaagaagggttagaatatgtccaacagatacatcgtctcacccacctaggaactaaacacctgcagcagttggtcagaacatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaaaaaaatactggaggaaatttttccgagatttggaatacctaaggtaatcgggtcagacaatggtccagcttttgttgcccaggtaagtcagggactggccaagatattggggattgattggaaactgcattgtgcatacagaccccaaagctcaggacaggtagagaggatgaatagaaccattaaagagacccttactaaattgaccacggagactggcattaatgattggatagctctcctgccctttgtgctcttcagggttaggaacacccctggacagtttgggctgaccccctatgaattgctctacgggggacccccccccgttggtagaaattgcttctgtacatagtgctgatgtgctgctttcccagcctttgttctctaggctcaaggcgctcgagtgggtgaggcaacgagcgtggaagcagctccgggaggcctactcaggagaaggagacttgcaagttccacatcgcttccaagtgggagattcagtctatgttagacgccaccgtgcaggaaacctcgagactcggtggaagggcccttatctcgtacttttgaccacaccaacggctgtgaaagtcgaaggaatctccacctggatccatgcatcccacgttaagctggcgccacctcccgactcggggtggagagccgaaaagactgagaatccccttaagcttcgcctccatcgcctggttccttactctaacaataactccccaggccagtagtaaacgccttatagacagctcgaacccccatagacctttatcccttacctggctgattattgaccctgatacgggtgtcactgtaaatagcactcgaggtgttgctcctagaggcacctggtggcctgaactgcatttctgcctccgattgattaaccccgctgttaaaagcacacctcccaacctagtccgtagttatgggttctattgctgcccaggcacagagaaagagaaatactgtgggggttctggggaatccttctgtaggagatggagctgcgtcacctccaacgatggagactggaaatggccgatctttctccaggaccgggtaaaattctcctttgtcaattccggcccgggcaagtacaaagtgatgaaactatataaagataagagctgctccccatcagacttagattatctaaagataagtttcactgaaaaaggaaaacaggaaaatattcaaaagtggataaatggtatgagctggggaatagttttttataaatatggcgggggagcagggtccactttaaccattcgccttaggatagagacggggacagaaccccctgtggcagtgggacccgataaagtactggctgaacaggggcccccggccctggagccaccgcataacttgccagtgccccaattaacctcgctgcggcctgacataacacagccgcctagcaacggtaccactggattgattcctaccaacatgcctagaaactccccaggtgttcctgttaagacaggacagagactcttcagtctcatccagggagctttccaagccatcaactccaccgaccctgatgccacttcttcttgttggctttgtctatcctcagggcctccttattatgaggggatggctaaagaaggaaaattcaatgtgaccaaagagcatagaaatcaatgtacatgggggtcccgaaataagcttaccctcactgaagtttccgggaaggggacatgcataggaaaagctcccccatcccaccaacacctttgctatagtactgtggtttatgaacaggcctcagaaaatcagtatttagtacctggttataacaggtggtgggcatgcaatactgggttaaccccctgtgtttccacctcagtctttaaccaatccaaagatttctgtgtcatggtccaaatcgtcccccgagtgtactaccatcctgaggaagtggtccttgatgaatatgactatcggtataaccgaccgaaaagagaacccgtatcccttaccctagctgtaatgctcggattagggacggccgttggcgtaggaacagggacagctgccctgatcacaggaccacagcagctagagaaaggacttggtgagctacatgcggccatgacagaagatctccgagccttagaggagtctgttagcaacctagaagagtccctgacttctttgtctgaagtggttctacagaaccggaggggattagatctgctgtttctaagagaaggtgggttatgtgcagccttaaaagaagaatgttgcttctatgtagatcactcaggagccatcagagactccatgagcaagcttagagaaaggttagagaggcgtcgaagggaaagagaggctgaccaggggtggtttgaaggatggttcaacaggtctccttggatgaccaccctgctttctgctctgatgggaccgctagtagtcctgctcctgttacttacagttgggccttgcttaattaataggtttgttgcctttgttagagaacgagtgagtgcagtccagatcatggtacttaggcaacagtaccaaggccttctgagccaaggagaaactgacctctagccttcccagttctaagattaaaactattaacaagacaagaagtggggaatgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacaca

SEQ ID NO: 163 - DNA, 5657 bp, artificial
  ss1301 sequence
  misc_feature (5656)..(5657): n is a, c, g, or t
agagatacaaacagtttatgtgagaagggatgaggaaaagcaaaaacaaagggccaagatcatgtttgcatatcaacaaaaacaagacagatcaaatcaaaggggtcctaaggacaaaagtaagagagggtcacaatatcaacctcaccgttatccagaaacaggacataagggaaagaggactagatggcaaggtgaaaaaaaatgccttagttgtggctaattgggacatttcaaaagggaatgccctggatggaaaaaggaggagaaaacaatccctctcatgttatttgaggaagatgaggactagcggtgtcaggggctctcaatagtgattgaccatcttaacaatccacaggtgccctacccagagcccttgataaatttagaggtagggccataccatgaaactatgatttatcttattgactcaggggcgtctcactcctccctttgttatttgctttctccttctcatgaacagatactagtatctggggtaaaaggggagggatttacatcaaaaaatttagaagaaaccaaaaataaatttgcaaaacagatgtgccaatatatgttttctttttgttccagaggctggcacaaacctgtgcagaagagacctaatggccaaatttggactaggcttgtaggttacccaagacctttacaagtaaaattgaatcttttaaccccaacagtggagggacaatttcaacctcaaatgtggcagcaaagggaaatcatgggggacttaaagtgaccccagttaaaatatagttaaaaatccctggagaagtagtctggagaaaaaaataccctatccccttacaaggaaggatgggacttaaacaaattatagagggactacttcaagagggtctcttggaaccctgcatgtcttcctataatacccctattctccctgtgagtaaggcggatcggtcctattgctcagtccaggatttatgggcaattaaccagattgttaagactagacatccagtggtcccaaacccttataccctcctgagtaaaatttcatttgaccaccaatggttcagtgtaattgaattgaaggataccttttgggtattccccctggactcagacatttggggcctatttgccttccaatggacccagtaactggcagaagaaacaatatagatggacagtcctcccccaggggtttacagactccccacatcttttgggggcaaattttagaacaggtgttgggagactttatactccctcataggacctgtctactccaatatgcagatgatttgttactctcaaacactgatcaaaagaaacttatagcagctacagattcccatctcaattttcttggggaaaaagaccttaggctctctaagaagaagttacaatttgttgaaagggaggtaaaatatttacaacatctaacaagtgggggtaaaagaaaattcagcccaaaaagaatagaggggatcataggccttcctctaccaactaccaaatgtgaactaagaaaattttgggcttgattgggtattgtcacctttggattgattcttatgcattaaaaacaaaaatctatattctaagattgtggaggaaggccctgatcccctactatggagccaggagtaaatacaataattcagggatctgagggaggtgctgactggtgcctctgttctgcctctaccatcctttgaaaaaccttttcatttatttgtaagtgtgaacaggggaatggctctaggggtcctcacacaggaacatgggggaagttgccagccagtggcctttctttcccacctccttgaacctgccaccaaaggatggcctgagtgcatacagttggtagccaccattgccgtcttaactgaagcgagcaggaaactcgcctttgggggaagggtaactgttactactccacaccaggtatgccatagtaaacaaaagggtagggagatggctcactcactcctgaattttaaaatatgagataatcttattggaaagggatgacttaactttaaccactgatgaggccttaaagcctgcctcttttctcactcaaagggagccctcaactcccatcaaatgttattgttaaaatttaatagactatcagaccaaaacttgacctgatctctgggaaactcccttccattcagatatttattcattgagggatcttctcaagtcatacagggaaaatgacacaatggttactcagtcattgatggagagattcaattgatacctgagtcaggaagactcccaaatgcatggtcagctcaaacttgtgaatgctttgcccttaaccaagccttaaaatgttaaaaaaaaaaaaaaaaaaaaaggagggcacaatctatactgactctaaatatgcctttggagtcatccataactttggaaaagattggatgaagaggggaattattaacagtaaaggatatggagaattaattaaatgagtactcaataatctccaacaaccagaagagatagcacaagaagggggactcatttgatgcccaaggaaattccttagcagatgaggaagccaagagagtggcatgagagtcagaggttcctatcttccttcttactttccccccttcccaaaataatgatctctcccttctttttggaaaaagagaaagaacagctacatcagctgggggcccaacctgacactcagggaagatggttcctcccagactgtagggaaatgctatccaaaccccttaggagagaaattctgacatacctacaccaagggagccattgggggcctcaagccatgtgtgacacagtcttaagggtctatgagtgtgccagtatttgcacaataggcaaacaggtaatagaaggttgcttaacatgcaaaaagaccaataaaaggactttatgaaaaacagcaatgggaggaacatctcctggtttaaggcctttccatagtatccaaattgattacactgaaatgcccaaagtaagaccacttaaatacttcttagtcagcatagaccatctaactcattgggtggaagccaccccattacccagtgacactgccaattatgtgacaaaggccctattagagcaaattattgccagatttgggatggttgaaaacatagatttggataatggaagtcattttacagctcagataataaagaattagaatattaaatgggaattcctaactctccaaagaattagatattaaatgggaatactatactctgtggcagcctccctcttctggttgaattgagagactgaaccaaactctcaaaatttacttaactaaattaatgctagaaacctggctaccctggacaaaatgtctccctattgctttactcagaattggaactgctccccaaaaggatgtctgtctatctccatacaaaatgttatatggacttctttacctgggtagatcatctgacttgcctacctttgaaaccaaagatcaacttttaaggagttatgtatttggtttatcctcttcatcttctcagacagaagggattactagcccaggtgccactgcttgatttcccagtcaattcacatcagcccagagactatgtgttaatcaaatcatggaaagaagacaaactccagccaaactgggagggacctttcctcatgttactgaccacccaaactgcagttcaaatggccaagcaaggatggactcaccacacctgggtgaaaaaaggggtgggcataacagacaaagaacaatgggtggattctgcagtgatcaccaaaacccagttggtcttaaaaagagcttgaaattattcctgttatgggtgattatttggagatcattattatttggtagtcaaggtgaatcatgggaccctctaactctgagatattatcaaggcctggaattatgggcaggttatccacctaaattagttattaacttaatccagactcctaacgcaatagtcataaaatttgatgcttgccaggttctagattgtgggactctagaaagtcaaagaaaactttcatctgtaggtaaatacctttgtccagaactcagcccacaagaactatatagacaaggggggaaatgggactataagtacccatgtgcaagttagaatgacgtttggtgtaccacccaatacaaggggtggactttaccccatgctggtaatttatgagcatcaagggacaaattcacacctcaaagggaaagcccccaattagtagtacccacttaacatgtaatccaatcttgttgactatcaacaacccagccaccgtagatagcaacttgaatatatggtttaggagctgatatttctgggacagacctagtgggatgaatggctcttaggttagtgccttcaacccacccaaatattctttctttccaatctctaagatccattcctcctcttagacccacacctcttcccaattcatgccccaaaataaccctaatatagctgaaatagtcgaagttgccagtctcaaacaaacaattcagatagaaacaggatatggggaaacaaatgcctggttggaatggataaaatattctgtgggcacattacataagagcaattgttacacctgtgccacagggagactggaggcccaagtagttccctttcctctgggatggtcgtcagacccatggggtcttgaatgtatgatgtccctcttccaggacaaaacaacttggaataatgagtccttttggactttgtcactgctatttcctgaaatcaaaagttctgtgaatcagctccagagagctgttcagccaccaaataaaaagcatcaacttctcctcctgtctaaaatgacagggtacagaggtgactttcttaggcaacctgaccaggtgcagtgaaagctggtcttacaataccctccacaataaattccagttctgagtgccccaggcagatgtctggtggtattgcggggggtccactagtgggcagtcttccagaaaattggagtggcacctgtgctttggtgcaattgaccatccctttcaccctggcatttagacccaatctcaaactcagccaatctgaaaggaacaagacaccactccaggggggtcctttgacccccaggtctatgctgactcaataggtgttccatagtgtgtcccaaatgaatttaaggcaagaaatcaaatagctgttggatttgaatctgttctcttttggtggtcaaccataaacaaaaacgtcgattggataaactacatctattacaatcagccaagatttgttaattacagggatgccattaaagtaatagccaaacagctagggccaactagtcaaaaggcataggaaaacagatttgcttcagacatgatgctggcagaaaagtgtgtaatctttgtaatgattggtatccactgctgtacattcattcccaataaccctgccccagatggcaccatcactaaggccctacatggattaacaaccttagcaaatgagctttcagagaattctggtattaataatcccttcacagaccttttagaaaattggtttggaaaatggaagggacttatagcttcaatctttacccttctaattgtcatagttagtgtccttatcttagttgcatgttgtataattcnn

SEQ ID NO: 164 - DNA, 8291 bp, artificial
  ss1646 sequence
gctcacagcaacgccagatccttaacccactgagagaaggccagggatagaacccgcaacctcatggtttctagtaggattcactaaccactttgccatgacgggaactccgagcctgtatttttggatatgagaacttagaagattttggcaccacttctactacattttaaagattaggagacagagccaggttctgtaaggaagatgttactttttggatgctgtgatagagaataccttttctaggaggctgttctgctggaggactgaaatattaccaaacactattaacattattcacgttctcaaatgttgtagttatcacaaagccattgacccccttaaaagtaaaccaaagtactggatattgaccactaggtagaagaactaaaactgtgtaatttttttggagttccgtcatggctcagcagttaacgaacccaactaggatccatgagaatgcaggtttgatccctggcctcactcagtgggttaaggatctggcattgctgtgagctgtggtgtagatggcagacgtggcttggatctggcattgctgtggctgtggcagaggcaggcagctacagctccgattcgacgcccagcctgggaacctccatgtgtggtggatgcggcccaaaaaagacaaaaaaaaaaggggggggggagacagaaagaaatacctgccaaacactgagaggcaagatagtatctaacaggaaaggaactctgtagatgttaatgttactgagaagaaacatacccttctgtttgatacagtggcgctttcatatatgtttttgctacagggcaaatggattttgaaggtttagcttattcattaaattcatgatttcgcgttctgcaataagtgagctggtatgtgcgtgtgcgtgtgtgtatgaaacagaatgcagcatgtgttccacctgttccacctgggtgcttacaatctaattggaggagtcaaggtcccccacacaactgttagaccattaattctaaggcatgagataagcaaatgtaagaatgtgggcttcgtaccactcattgtacagaacaccccacacatatccacacgtgctttttacctgagtggttaagatagcgctctgagaggacagccccgagcagtcttcagagaagcttgtttcgctctcatactcgaatgctgtttcaccttaaaggattgtaaaaatagagattcagaggtaataacagacagccaacgctctaacttgctgtatctgtttctttccactggcaggacaaacttcactttcatgtcacacaaaaacgattacactctttggggacaaagaaaccgtaagaatgaaaaccagaagcaagtccaccaataattagggcatgaaacctcattcaagcagaaaggatgttctaaccgggtgaaggacttttaaggaaaagcaccttgggaggaacatgtttaaagtttaagcagcagatactttttgtacttggaagctcgtaaaatgtgcttcccccaaaggcaataagcatttagctattttctataaaacagacaggggcaaacacaaaaacctggttccaatacctaagtctgagtccacaatctgctcttcttggcaattatcctcttccaggccagtctccctttcgtcatcctctgaaaccaattccttgtcactcagaacttcctggttttcagactgatgctccacttgtttggaaggaggatcaaacatcaagaaaggatcttggctgtttgtattggcggccgagtcttccaacgcgctgcactgtgaagaaaataagctaccagaacatctcacgtcctcgctaaggtgatgctcctgggatgcctttgccgaagttacctggtcactgcagtcatttaagctattcttcagtgacactaggctctcccctgcctccttagatagaccctctgcggcaacagcattatgtctggtagatggagaaggcgtattggtcactttaccaaataataagtgttggaagcaaggaagctcttcatcctcactagacccactctcttctgaagactctaatttcctagcccatctttggtgaccctgagccaaacgtctgtgggctaaagggctagggctccttttaaattccccttcttgggcacttttgctaaaaacagcagatctttccttaacgtcactttcagcaaagttgagattttcctttattttgtcatcatttaacaggtcatcaggtgtctcagaacaaatctgagaagcatgactacttcccataggttgttcggggttatctgaaattagatatggggagaaatctgcattaacagcctgaaatatgccttcattttctccttgcctttttatttctgtgtggttacaattacttacaggaagactttgcttataaacttcgggttgcatgagacctaatctgagcattgcacttaatttaggtcctctgtttctacctggttctgctcgaacgttttcaccgctggaacctacttcattaatactagagcctacttcgttggtactggacccgacttcattaggactgcctgagctgccttctttaaaagttctctcttgaatgttattttggctaactgtgctctctgtatttggaatgatgctctcgtttcccattgttctttcgggtgacattttaggttcctcaaacttttcctctgacaggtttttcttacatatagttttaacagacgacctgatgggagaaagggatggtatgacatatgggttttgtgaaatcccaggtttatttgcattaatgaactcagttttgtggcctctgaactgtgatgtctgataaagcccagttactccttttgcaccacatttggcaaaatcactcggcttcttatccttttgaccaaccactagaaagtccacagttgtatgaactgactgcccatgcttgactttagactcactctttccctgattttcatctttttgtccaccttcatgagtgacttttggactttgttctcttaaggacttggagtgggcatggacggttgtacattccttttctggatttgctggatttgaaaacagagcaaatgtctgacgctttgaaaccttgaacatactctgcaaatactgtgtatcaagttcattctcttccacttctatgcttgcttcctgagtgtggttaacatcatgagccaggggatccttaaagtcccctgtgtcgtttctaacacctttagaacaaccaaggctaagttctttggggttttcagttgctgcacacagcctcacatgttgattgggtgttgtttttgcctttcctagggtgtcagtttccagtaatgagatactgtcctgagtgccataatcagtatcaggtaccagggaaatactggtattctctacagatctttcaatttgaaaaccttttcctccacttaacatcacatctttggggtctttgttactattcgacacttgaattgtccctaggttctcttctctttgaaggttaggactgacagattcttgaagcttattagaatttgaacagttagtaatagaaacaggtacatttgttaaatttagttctggaaaagcatcactgataggtcttttatttacttgttcatgtggcctattattcttcttggctccagttgtaggttctttatctcccctgaggtgaagctttttgctgtgcctgactggcacttggtcggaatttctcttcttcatctcttcactgctagaacaactatcaatttgtaactcagtatgactaggtgggcttgggtttctattgactactagttcaagtgcatggatctgcctggtagaggacttcctcctcagcctgttctttggtgctttcgaaccatggatattcaattctagttccatattgcttatactgctgcttataggttcagccctagctctgaaagcaggttcttttcccaacgatgcagttgggttaacatttttctctttctgaacattaccactttttgtttcattctcatgacctttactggtaatattcatcccctgaccattctgctctgtctcatcagttccctcaattgtcttttcaggagtttttggaacaactgccgaatcggctctcttgataaaatcctcgggatcaaggcctgatgtacctctccttttccgctttagtttatttgtgagggggcgctcttgtgttatttgaggctctacagcagatgctcctaaaattagatcttcaattacgtggctcaagttagggaggcttgccttcctccgataggttttcccaaatattttatcttcaatattactctctgctggtttggagtgccctctttcacgttcacgtattaaagcaccatgagggtcactggccattaagtctattttctctgaagaacccaaatgtccatctgcttcatttggaacctctgctgcaccagctaccccagtatttgattcagacctcctgtcctgtgagtcgtcagaagttaacatttcatcgcttctagaaaaccactcattaactttctgtatgctactattcaatgttatccaaggaacatcttgggaatctctaggactgtcagagcacgcaggtttctgcttattcagttcgtttctcccatacaggagatcagtattcagaactacctttttctctgtgttaggagtctgcctatcattacatgtgcccttactttcagcccatctgctctgttggctctttgctaagacaggctgcttgcttttattacaaaattcagccttttctacattcattctgtctttagtgagtaataaactgctgttctcatgctgtaacgagctggcatgagtatctgtgccacatggctccacatgcaagtttgaaacagaaataccctcatatttttctggatgcttctcagttgcatgcttctcagtagcggtcaaatctttattactggaatgatgatgttcagtatttgttatgtccttctcagaaaactgacaagcatctagaaaagaaaaaaaagaaaaaagaaaaaaaaatacttaaagctgaattattatggaaaaaaatatgtacttaatacaacttgggcaagaggaatgaagaaattggctattcttagaaaaactaacctcaaactacgaagtataatgaagatgtagctcaggagttcccattgtggctcagcaggttaagaacctgacatagtatctatgaggatgtgggttaaggatctggcattgctatggctgtggcataggctggcagcgacagctttgattcaacccctcgctctaggaacttccgtatgttcctaaaaaaaaaaatagaaaagaaaaatgaagatgtaggtcacactctttgtttagttcctatttatctggattctcattatttccactcagataattaaaattttaatttcagaattctccctactcataaaccatacctcctatttccctgacctcttaacagtgaattaaaagcacagtttgggcatcagagatatagtgctctgttctatcctcagattcagacttcctatatcgaaatgccagtatgcaaaatatgaaatataaacaaagcaattaaaggtaaaaggcaacaaccgattacacagggtactataataaccgcaccgtctactgcctttgaagtagattaggctgcaccatggtatctgagatagaaccatattctaactctgccaagagatggtatgaattataaatgtcccgaatggtcttcagaataatctaattacagttctttatctacccattctctcttcagtacccattaagctggaagacttgtcattacccttttttgcttcagccttggctccttgaggggtggtttctaacaatccatggtctcccccactacagggaaaagatagaagccttagtgagaaatgctagttacatgctcatacagttgtcaaataagtattttagccctccaggtagagttgcaataagctgatcaatttgattcactttatgaaataaatccatgctatccattagtaacctctagtcaaaatgaaatggtcaaagactgacaacatacagtcacaaaaaccagagcagtagtaaagaatactgctttatagacatacaaatgagaactaaaattcaaatgacaggagttcccgtcgtggcgcagtggttaacgaataggacgaggaaccatgaggttgcgggttcagtccctgcccttgctcagtgggttaacaatccggcgttgctcagtgggttaacgatccgtgagctgtggtgtaggttgcagacacggctcggatcccgcgttgctgtggctctggtgtaggccggtggctacagctccgattcaacccctagcctgggaacctccatatgctgcgggagcggcccaagaaatagcaacaacaataacaacaaaagacaaaaaaaaaaaaaaaaaaaattcaaatgacagtcaagcaatagctaagagataataaagaaaaaaccaacaaaacttaaagtatatcttaatgagaacacaagagcaaaaatatctaaacaaagggagcactacgatgaaaaaaaaatcccaataaaatgcaaagaatgtaccactatgcaacactgtcttctgtgcttctttttaggctaaaaattgttttctctcaattgagagatcaggaaaaagtcatttgcaaagaaatctgattggcaatgacactattataattcagacaagccatcacagcccttaggtcatacagtaattcctaaggaaggcaacttggcaggtaacccagtagggatctacttgtagattatggtttaatttatgtagacaaagctggaagaacagacagaattaaggaacagaggaaggaattgaaaactgagtgctctaatattttcaatagccatactttactgctgtgtcaatacaaccacacacaaggatctaagctagagcacaaccatctgctggaatcaagtctgtttagagttctactgtgactttaaactctttcaaactctttgctaagtaacaaactaaacaaaaaagggtattttctcagcttataaaatgaaaagattaggagttcccgtcgtggctctgtggttaaggaatccgactaggaaccatgaggctgcgagttcgatcccgggccttactcagtgggttaagaatccagtgttgccatgagctgtgatgcaggtggcagatgtggctcagatcccgagttgctgtggctctggtgtaggctggcaaccacagctcctactggacccctagcctgggaacctccatatgccgaggaaatgacccaagaaatggcaagaagacaaaaaaaaaaaagaaaaagaaagaaagaaaagaaaaagaaaaagaaaagattaaagcagatgatctttaaagttcattccaacaccacgattctaacctaaagaaatacctgctgtggctcagtggattaagaacctgaaaggtattcatgaggatgtgggttggatccctagcctcgctcggtgccttaaaggatctggtgttgctgtggctatggcaaaggccaacagctatggctcccattcaacccctagcctgggaacctccatatgcacaggtgcaaccctaaaaaaacaaacaaaacacacaaaaaatcctaatattaaatacaaaactgcaagcttcatagaaaagaccctctttgactcacctgcaataatttgccttattaactgtatcttcagaagaatcagatcctaaaaaaaattccccaaatacccccacataacaaatcaataggatttttattgaagggttaaattttaaaaatatatttgaaaaacagatattcattcaagaaatatttacagagcatctattacatggcaggcaaaatgatgcatgtcaggcaatatagggaagtagttacaagcagaggctctgaagctggaattctcaggtttgaatcatggctctgccagctacggctttaaaaccatgacaaaatttctttttctttctttctttccaacaagtcctattgattattctttttattattttttttaattttcaaaaacatttattatagatgatgttgacaaaatttcttaacctctctgtgccttattcttttatctgtaaaaaaaatacagtaatagcaaccacctcaggtttgtcatgcatttttttttttttcttattaaggctgcacctgcagcatatggaagttcctgggctaggggtcaaatagaagcttgggctgatggatacaccacagccacggcaac

SEQ ID NO: 165 - DNA, 8578 bp, artificial
  ss1329 sequence
tgccacaaaatgttgaaaatcctgataaatatatcttggtgacaatatgtctcccccacccagagacaggcacaaacatgtaactccagaacaacttaaaattaattggtccacaaagcgcgggctctcgaagttttgaattgactggtttgcgatattttaaaaatgattagtttgtaaaagcgcgggctttgttgtgaaccccataaaagctgtcccgactccacactcggggccgcagtcctctacccctgcgtggcgtacgactgtgggccccagcgcgctcggaataaaaatcctcttgctgtttgcatcaagaccgcttctcgtgagtgatttggggtgtcgcctcttccgagtcaggacgagagggattttaactcgactggcctttcagtttggtgcgttggccgggaaacccgcgactacccctcacacccgagaaccgacttggaggtaaagggatcccctttggaacgtgtgagtgtgtgtgtcggctggcgtctctgttctgagtgtctgttttcggtgatgcgcgctttcggtttgcagctgtcctctcagaccgtaaggactgggggactgtgatcagcagacgtgctaggaggatcacaggctgccaccctgggggacgccccgggaggtggggagagccagggacgcctggtggtctccttctgtcggtcagaggaccgagttctgttgttgaagcgaaagcttccccctccgcggccgtccgactcttttgcctgcttgtggaagacgcggacgggtcgcgtgtgtctggatctgttggtttctgttttgtgtgtctttgtcttgtgcgtccttgtctacagttttaatatgggacagacggtgacgacccctcttagtttgactctcgaccattggactgaagttaaatccagggctcataatttgtcagttcaggttaagaagggaccttggcagactttctgtgtctctgaatggccgacatttgatgttggatggccatcagaggggacctttaattctgagattatcctggctgttaaagcaattatttttcagactggacccggctctcatcccgatcaggagccctatatccttacatggcaagatttggcagaggatcctccgccatgggttaaaccttggctgaataagccaagaaagccaggtccccgaattctggctcttggagagaaaaacaaacactcggctgaaaaagtcaagccctctcctcatatctaccccgagattgaggagccgccggcttggccggaaccccaatctgttcccccacccccttatccggcacagggtgctgcgaggggaccctctgcccctcctggagctccggcggtggagggacctgctgcagggactcggagccggaggggcgccaccccggagcggacagacgagatcgcgacattaccgctgcgcacgtacggccctcccataccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaacttggctaaggtaagagaggtgatgcagggaccgaatgaacctccctcagtttttcttgagaggctcatggaagccttcaggcggttcaccccttttgatcctacctcggaggctcagaaagcctcagtggccctggccttcataggacagtcagccctggatatcagaaagaagcttcagagactggaagggttacaggaggctgagttacgtgatctagtgaaggaggcagagaaagtgtattacaaaagggagacagaagaagaaagggaacaaagaaaagagagagaaagagaggaaagggaggaaagacgtaataaacggcaagagaagaatttgactaagatcttggctgcagtggttgaagggaaaagcaatagggaaagagagagagattttaggaaaattaggtcaggccctagacagtcagggaacctgggcaataggaccccactcgacaaggaccaatgtgcatattgtaaagaaaaaggacactgggcaagggactgccccaagaagggaaacaaaggactgaaggtcttagctctggaagaagataaagactagggaagacggggttcggaccccctccccgagcccaggataactttaaaggtggaggggcaaccagttgagtttctggttgataccggagcgaaacattcagtgctactacagccattaggaaaactaaaagataaaaaatcctgggtgatgggtgccacagggcaacaacagtatccatggactacccgaagaacagttgacttgggagtgggacgggtaacccactcgtttctggtcatacctgagtgcccagcacccctcttaggtagagacttactgaccaagatgggagcacaaatttcttttgaacaagggaaaccagaagtgtctgcaaataacaaacctatcactgtgttgaccctccaattagatgacgaatatcgactatattctcccctagtaaagcctgatcaaaatatacaattctggttggaacagtttccccaagcctgggcagaaaccgcagggatgggtttggcaaagcaagttcccccacaggttattcaactgaaggccagtgctgcaccagtgtcagtcagacagtaccccttgagtaaagaagctcgagaaggaattcggccgcatgttcaaagattaatccaacagggcatcctagttcctgtccaatctccctggaatactcccctgctaccggttagaaagcctgggactaatgactatcgaccagtacaggacttgagagaggtcaataaacgggtgcaggatatacacccaacagtcccgaacccttataacctcttgtgtgctctcccaccccaacggagctggtatacagtattggacttaaaggatgccttcttctgcctgagactacatcccactagccaaccactttttgccttcgaatggagagatccaggtgcgggaagaaccgggcagctcacttggactcgactgccccaagggttcaaaaactccccgaccatctttgacgaagccctacacagagacctggccaacttcaggatccaacacccccaggtgaccctcctccagtacgtggatgacctgcttctggcgggagccaccaaacaggactgcttagaaggtacgaaggcactactgctggaattgtctgacctaggctacagagcctccgctaagaaggcccagatttgcaggagagaggtaacatacttggggtacagtttgcggggcgggcagcgatggctgacggaggcacggaagagaactgtagtccagataccggccccaaccacagccaaacaagtgagagagtttttggggacagctggattttgcagactgtggatcccggggtttgcgaccttagcagccccactctacccactaaccaaagaaaaaggggaattctcctgggctcctgagcaccagaaggcatttgatgctatcaaaaaggccctgctgagcgcacctgctctggccctccctgacgtgactaaaccctttaccctttatgtggatgagcgtaagggagtagcccggggagttttaacccaaactctaggaccatggaggagacctgttgcctacctgtcaaagaagctcgatcctgtagccagtggttggcccgtatgcctgaaggctatcgcagctgtggccatactggtcaaggacgctgacaaattgactttgggacagaatataactgtaatagccccccatgcgttggagaacatcgttcggcagcccccagaccgatggatgaccaacgcccgcatgacccactatcaaagcctgcttctcacagagagggtcacgttcgctccaccagccgctctcaaccctgccactcttctgcctgaagagactgatgaaccagtgactcatgattgccatcaactattgattgaggagactggggtccgcaaggaccttacagacataccgctgactggagaagtgttaacctggttcactgacggaagcagctatgtggtggaaggtaagaggatggctggggcggcggtggtggacgggacccgcacgatctgggccagcagcctgccggaaggaacttcagcacaaaaggctgagctcatggccctcacgcaagctttgcggctggccgaagggaaatccataaacatttatacagacagcaggtatgcctttgcgactgcacacgtacacggggccatctataagcaaagggggttgcttacctcagcagggagggaaataaagaacaaagaggaaattctaagcctattagaagccttacatttgccaaaaaggctagctattatacactgtcctggacatcagaaagccaaagatcccatatccagagggaaccagatggctgaccgggttgccaagcaggcagcccagggtgttaaccttctgcctatgatagaaacacccaaagccccagaacccggacgacagtacaccctagaagactggcaagaaataaaaaagatagaccagttctctgaaactccggaggggacctgctatacctcagatgggaaggaaatcctgccccacaaagaagggttagaatatgtccaacagatacatcgtctaacccacctaggaactaaacacctgcagcagttggtcagaacatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaagaaaatactggaggaaatttttccaagatttggaatacctaaggtaatagggtcagacaatggtccagctttcgttgcccaggtaagtcagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggtgaggaacacccctggacagtttgggctgaccccctatgaattgctctacgggggaccccccccgttggcagaaattgcctttgcacatagtgctgatgtgctgctttcccagcctttgttctctaggctcaaggcgctcgagtgggtgaggcagcgagcgtggaagcagctccgggaggcctactcaggaggagacttgcaagttccacatcgcttccaagttggagattcagtctatgttagacgccaccgtgcaggaaacctcgagactcggtggaagggaccttatctcgtacttttgaccacaccaacggctgtgaaagtcgaaggaatccccacctggatccatgcatcccacgttaagccggcgccacctcccgattcggggtggaaagccgaaaagactgaaaatccccttaagcttcgcctccatcgcgtggttccttactctgtcaataactcctcaagttaatggtaaacgccttgtggacagcccgaactcccataaacccttatctctcacctggttacttactgactccggtacaggtattaatattaacagcactcaaggggaggctcccttggggacctggtggcctgagttatatgtctgccttcgatcagtaatccctggtctcaatgaccaggccacaccccccgatgtactccgtgcttacgggttttacgtttgcccaggacccccaaataatgaagaatattgtggaaatcctcaggatttcttttgcaagcaatggagctgcgtaacttctaatgatgggaattggaaatggccagtctctcagcaagacagagtaagttactcttttgttaacaatcctaccagttataatcaatttaattatggccatgggagatggaaagattggcaacagcgggtacaaaaagatgtacgaaataagcaaataagctgtcattcgttagacctagattacttaaaaataagtttcactgaaaaaggaaaacaagaaaatattcaaaagtgggtaaatggtatgtcttggggaatagtgtactatggaggctctgggagaaagaaaggatctgttctgactattcgcctcagaatagaaactcagatggaacctccggttgctataggaccaaataagggtttggccgaacaaggacctccaatccaagaacagaggccatctcctaacccctctgattacaatacaacctctggatcagtccccactgagcctaacatcactattaaaacaggggcgaaactttttagcctcatccagggagcttttcaagctcttaactccacgactccagaggctacctcttcttgttggctttgcttagcttcgggcccaccttactatgagggaatggctagaggagggaaattcaatgtgacaaaggaacatagagaccaatgtacatggggatcccaaaataagcttacccttactgaggtttctggaaaaggcacctgcatagggagggttcccccatcccaccaacacctttgtaaccacactgaagcctttaatcgaacctctgagagtcagtatctggtacctggttatgacaggtggtgggcatgtaatactggattaaccccttgtgtttccaccttggttttcaaccaaactaaagacttttgcgttatggtccaaattgtcccccgggtgtactactatcccgaaaaagcagtccttgatgaatatgactatagatataatcggccaaaaagagagcccatatccctgacactagctgtaatgctcggattgggaatggctgcaggcgtgggaacaggaacggctgccctaatcacaggaccgcaacagctggagaaaggacttagtaacctacatcgaattgtaacggaagatctccaagccctagaaaaatctgtcagtaacctggaggaatccctaacctccttatctgaagtggttctacagaacagaagggggttagatctgttatttctaaaagaaggagggttatatgtagccttaaaagaggaatgctgcttttatgtggatcattcaggagctatcagggactccatgagcaagctcagagaaaggttagaaaaacgtcacaaagaaaaagaggctggccaaggatggtttgagggatggttcaacaagtccccatgggtgaccaccctgctttctgctctaacaggacccctagtaatactgctcctgttgcttacagttgggccttgcttaattaatcggtttgttgcctttgttagagaacaagtgagtgcagttcggatcatggtacttagacagcagtaccaaggccttccaagctaaggagaaactgacctttagccttcctagttctaagattagaactattaacaagagaagaagtggggaatgaaaggatgaaaatgcaacctgactctcccagaacccaggaagttaataagaagctctaaatgccctcgaattccagaccctgttccctataggtaaaagatcatactttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcataagataaaaagaggagaagtcaattgcctaacggaccccagtaagatcgggcgtgccacaaaatgttgaaaatcctgataaatatatcttggtgacaatatgtctcccccacccagagacaggcacaaacatgtaactccagaacaacttaaaattaattggtccacaaagcgcgggctctcgaagttttgaattgactggtttgcgatattttaaaaatgattagtttgtaaaagcgcgggctttgttgtgaaccccataaaagctgtcccgactccacactcggggccgcagtcctctacccctgcgtggcgtacgactgtgggccccagcgcgctcggaataaaaatcctcttgctgtttgcatcaagaccgcttctcgtgagtgatttggggtgtcgcctcttccgagtca

SEQ ID NO: 166 - DNA, 5207 bp, artificial
  ss1334 sequence
tgttttttgttcagggtccatgattgggaagtgattccctgtggaactgcctgcataataaagctgttctccatcttccttgagtgtcctctgaggtgatttctgggagttctacaacatattctggaggccccagtgagattccctcagagggactggcccattgaaccactgtcatcattggccagcaaccagccgcttctgagggtagacacacctccctgacttcagggaattcaggactggtgggctctgcagtattgggccaggtggactaatgagatggacccaggacaagtccggcccatagggaagaagaatgtatgtgaccaacccctggggacgagtgcactgagggaatggtacatgaatcatgggtggactctcctggttggaagttgtgcctgactggagcagtagccaggaaccactggggagtgggggtgaaaccgtgataacctctgtgtgtgtgagagagtgaatgtgtgacctgatttgcttgtgcttttggtttgagtttgtggctccacgactgtagcagctatggagtttgagtgggccctaacctgcagttccatggttacctcataaggctttaaggctgtgccaggctctgaggtactccttccctccctgtgagtctggtccaggtccaggctttatatggaccagccatatgctaagggacacctaatctcctgaggggaggtggtcaggtagacatcagaatggccaccttctgagaaggaagcacccacccttgcctcatctgtgacaccgacacagggtggccacacagggtgggatttagcttggagctggacctccaagtgcatcactgaggaaaacagatgtaagagtctgaggaagttgtgcctgtgaaaacttctttgagaagttaggatgcgaaagtttgactttaccagttcagaaactatgcagtaaggttttttgggactctctcatctgtcccttctgctgtgaaactcctccttttgatctgatttgggagttgccccctaagcaatatctaggggatggctggcatatttggctgttagtacatgtctgcactcactctcctgtgagtctgaggacatggtattaaaaaggacaaaagagaaaatcaggtattctggtcaaatgtcattctccttggaacactatgtcctccctgtcaagaaggatggagggaaagtttaccaaacagtgcaggatttgtggactgttaatgaggctgttgtgactcttcattccactgtccccaatctgtataccttgctcagtttaatgcctgcaaagacagcttggtttacctgcctagacttaaaggatgccttcttttgtttacaagtagtacctcaaaacctgaacttgtttgctttcgagtgggaggatccaaagagaggaagaaaagtccaattgacttggactaggctcccacaaggatttaagattcccctaccctgtttggagggtgctagctgctgacttaatggcctttctggcagaggagactggttgtcagatcctccagtatgtggatgatctcctattggcagccgaacatcgagaccaatgttagagggggacactggctttattgggctggttggaacaagctggatataaggtttcctggaagaaggcacaggtctgccaacaacaggtacactacttgggatttaacattacagctgggaggaggactttgggaattaaaaggcatcaggccttctatcaaattgagagactgacaaccaagacgcaagtgcgggactacatgggggcagctgggttttgctgcatctggataccaagcttctcaaaaatgctaagccactctatgaggctgctgctgggtctgggcaaacaccacttcagtggggcctaaataaaaataggcattcttaaagctcaaagaactggtcacaccggctcctgcactaggaattcctgatgtgactaaagactttaatttatttgtacacgaaaaggacaagtggctttgaaagtcttaacccagacggtagggtcctggcagagaccagtggcctacttgtccaaaaggctggactcagtggcctcaggatgacccccatgcatcagggccacatccgccatgacactaatggtaaaagaatctgataagctaaccttgagacagaagatatatgttaaggtcccatattctgtcccagccttgcagggccaggagccaagtggctgttaacatctcaagtcctccaccacaagggactattgcaaatccccatgtttgggtggcccccagccaggctattaaccagccactttccttccagtgcattcaggtctgcctgaccatgattgtgaagaaattttggaagaaatttatgccagtcaccctgatatccaggactcttcactgactgaggtggaggtaacatactacatggattgggccaactttgtgacttaaggacagagaaagtcagggtttgctgttacaactgaaagtgaggtaatttcttctgggaatttaccagtgggatggtcagggcaatgagcagttatgggccttatcaaagctctaaaactggcaaaaggataaaaggtcaacatttacacagactctaggtatgcatttactactttgaatgttcatgtgataatcaataaagaatgagtattttaactgctggaggcaaggaaataaaaaaataaagaagaaatcttaatgctcttggaagctgtttgggacccagaatgcactgcagaggacaccagaaaggacagacaacaaaggccaaaggaaactggctggctgaccaagcatccaatgaatcagctatacatgaaccacaggtaactgaggttctgttgatgccttcactcccagcacagctatatatagtaatgaagagctagaatggttaaaaattgaagggggaatgcagcaagctgatggatggtgggtgtcaccagatggatgaatctttgtgccttcctctctagcatataaaatcatacaagatttctatcagttgacccacctcggtaacacaaatgtatatgaacttttaatgtggtattgtattattccctgcttaatagctctgtgtgctcaggtcagtcaaagatgttccacttgcgctaagaataatgctgtaccaaggactccattgcctcctagaatacagataaaaggtaccctcccctttgaaagtttggaagttgattttactgaagtgatgccttgtcagggctataaatatctacttttcctaatatatacctattcagggtgggttgaggcctaccccacaaggactgaaaagacaagggaagtggcttgctgtttactgagagatgttatgtcctggtttggactgcccctcatcattcgatctgacaatgggccagcttttgtagctgagataattcaactgataaataagttattgggtattaatggaaattacacatggcttattggccacagaacttggggacgttaaaagaatgaacaagactcttaaacacaagagacaggactgaactgggtagatcttctaccaataacactcatgaaaatcaggatgacaccccaattgtctggctattccccttatgagattctgtttgggttccctccccctttaaaaaaagcattgaaaggagatgccttggtctctaaaaaattgggtttgtcacagcagatggaacagttgggaaaggtaatgaaagaaataaccaggtttacccaggaatgtatccttatcctgctgggtgtgagggttcattcatataaaccaggagatatggtgtgggtaaaagattggaaaagtaaaattcttcaacctattttggccagtccatatactgtgttactaaccacccctactgctgttaaggtctcaggtattcttccttgaattcatcacactagggtgaagactgctgcagaaaaaaacacctcctggaaaatagaaaaggacacagaccagccactgaaactcacccttaaaaaacaagaagaaaaaagacttcagctcagagcattgtgcaactactggagacaaccctgctgctactaggatatctaaaccaagtgaagacccaggaaaacatcttcatgtcatgggcccactcttatgcaaatgttcacaactgatccagccactgagtaagtggagccctgccaatgtctgtaatggatggactaccctggtagattcacctttctgtcagggtgatttggccaatttatgtgaatttttacatctgtttttcagtggtatgattacatggcaaccacattttttccatcaccagggactacagacatcatgatgagggtagaagctttaactgactttaccaagcaagatttaatagatgaaaagaaagctataatggcattaaatactgaacaaatgctaatgagaagaattgtcattcaaaatacaatggcactagacatcctaacagctgcccaaggaggggcatgtgccatcataaaagtagaatgttacatatatattcctgctctctctgataatgtaactgctacattagataatatgagaaatcaggttaggacaatgtcgaatgataatcttcctttctggacttctgttttgtcttggataaaaggggactggtggaaaaatgtaatactaatcatagttattacaccgctattattaatcttcagactttgtatttttaattgtgttactcagcttgttgcatcccatttaggaataatattccaagcccaactcctcaggtacagtatttgccaatgactgatgcacatcagaaaggatgagcctcaagaggggggaatgtatgggtgtgggaaagggaatagggaacttgaaaagagcaaagccattttgctgccactgtccatcttggtgaacttaaggtgactcataagagggctctgagaaaaacaaagtcattaggacttgagaaattccaaccctgattgttctaaagaaattcaaaaatagctagattgtacttgaggttaattattaaagtaactgcatgtaactaaagattagttagacatgtaagcaagcactataaatgtactccccctttttgtttggggtccatgattgggaagtgattccccatggacctgcctgcataataaagctgttctccatcttccttgaatgtcctctgagatgatttctgggaattctaca

SEQ ID NO: 167 - DNA, 5210 bp, artificial
  ss1335 sequence
tgttttttgttcagggtccatgattgggaagtgattccctgtggaactgcctgcataataaagctgttctccatcttccttgagtgtcctctgaggtgatttctgggagttctacaacatattctggaggccccagtgagattccctcagagggactggcccattgaaccactgtcatcattggccagcaaccagccgcttctgagggtagacacacctccctgacttcaggggaattcagggactggtgggctctgcagtattgggccaggtggactaatgagatggacccaggacaagtccggcccatagggaagaagaatgtatgtgaccaacccctggggacgagtgcactgagggaatggtacatgaatcatgggtggactctcctggttggaagttgtgcctgactggagcagtagccaggaaccactggggagtgggggtgaaaccgtgataacctctgtgtgtgtgagagagtgaatgtgtgacctgatttgcttgtgcttttggtttgagtttgtggctccacgactgtagcagctatggagtttgagtgggccctaacctgcagttccatggttacctcataaggctttaaggctgtgccaggctctgaggtactccttccctccctgtgagtctggtccaggtccaggctttatatggaccagccatatgctaagggacacctaatctcctgaggggaggtggtcaggtagacatcagaatggccaccttctgagaaggaagcacccacccttgcctcatctgtgacaccgacacagggtggccacacagggtgggatttagcttggagctggacctccaagtgcatcactgaggaaaacagatgtaagagtctgaggaagttgtgcctgtgaaaacttctttgagaagttaggatgcgaaagtttgactttaccagttcagaaactatgcagtaaggttttttgggactctctcatctgtcccttctgctgtgaaactcctccttttgatctgatttgggagttgccccctaagcaatatctaggggatggctggcatatttggctgttagtacatgtctgcactcactctcctgtgagtctgaggacatggtattaaaaaggacaaaagagaaaatcaggtattctggtcaaatgtcattctccttggaacactatgtcctccctgtcaagaaggatggagggaaagtttaccaaacagtgcaggatttgtggactgttaatgaggctgttgtgactcttcattccactgtccccaatctgtataccttgctcagtttaatgcctgcaaagacagcttggtttacctgcctagacttaaaggatgccttcttttgtttacaagtagtacctcaaaacctgaacttgtttgctttcgagtgggaggatccaaagagaggaagaaaagtccaattgacttggactaggctcccacaaggatttaagattcccctaccctgtttggagggtgctagctgctgacttaatggcctttctggcagaggagactggttgtcagatcctccagtatgtggatgatctcctattggcagccgaacatcgagaccaatgttagagggggacactggctttattgggctggttggaacaagctggatataaggtttcctggaagaaggcacaggtctgccaacaacaggtacactacttgggatttaacattacagctgggaggaggactttgggaattaaaaggcatcaggccttctatcaaattgagagactgacaaccaagacgcaagtgcgggactacatgggggcagctgggttttgctgcatctggataccaagcttctcaaaaattgctaagccactctatgaggctgctgctgggtctgggcaaacaccacttcagtggggcctaaataaaaataggcattcttaaagctcaaagaactggtcacaccggctcctgcactaggaattcctgatgtgactaaagactttaatttatttgtacacgaaaaggacaagtggctttgaaagtcttaacccagacggtagggtcctggcagagaccagtggcctacttgtccaaaaggctggactcagtggcctcaggatgacccccatgcatcagggccacatccgccatgacactaatggtaaaagaatctgataagctaaccttgagacagaagatatatgttaaggtcccatattctgtcccagccttgcagggccaggagccaagtggctgttaacatctcaagtcctccaccacaagggactattgcaaatccccatgtttgggtggcccccagccaggctattaaccagccactttccttccagtgcattcaggtctgcctgaccatgattgtgaagaaattttggaagaaatttatgccagtcaccctgatatccaggactcttcactgactgaggtggaggtaacatactacatggattgggccaactttgtgacttaaggacagagaaagtcagggtttgctgttacaactgaaagtgaggtaatttcttctgggaatttaccagtgggatggtcagggcaatgagcagttatgggccttatcaaagctctaaaactggcaaaaggataaaaggtcaacatttacacagactctaggtatgcatttactactttgaatgttcatgtgataatcaataaagaatgagtattttaactgctggaggcaaggaaataaaaaaataaagaagaaatcttaatgctcttggaagctgtttgggacccagaatgcactgcagaggacaccagaaaggacagacaacaaaggccaaaggaaactggctggctgaccaagcatccaatgaatcagctatacatgaaccacaggtaactgaggttctgttgatgccttcactcccagcacagctatatatagtaatgaagagctagaatggttaaaaattgaagggggaatgcagcaagctgatggatggtgggtgtcaccagatggatgaatctttgtgccttcctctctagcatataaaatcatacaagatttctatcagttgacccacctcggtaacacaaatgtatatgaacttttaatgtggtattgtattattccctgcttaatagctctgtgtgctcaggtcagtcaaagatgttccacttgcgctaagaataatgctgtaccaaggactccattgcctcctagaatacagataaaaggtaccctcccctttgaaagtttggaagttgattttactgaagtgatgccttgtcagggctataaatatctacttttcctaatatatacctattcagggtgggttgaggcctaccccacaaggactgaaaagacaagggaagtggcttgctgtttactgagagatgttatgtcctggtttggactgcccctcatcattcgatctgacaatgggccagcttttgtagctgagataattcaactgataaataagttattgggtattaatggaaattacacatggcttattggccacagaacttggggacgttaaaagaatgaacaagactcttaaacacaagagacaggactgaactgggtagatcttctaccaataacactcatgaaaatcaggatgacaccccaattgtctggctattccccttatgagattctgtttgggttccctccccctttaaaaaaagcattgaaaggagatgccttggtctctaaaaaattgggtttgtcacagcagatggaacagttgggaaaggtaatgaaagaaataaccaggtttacccaggaatgtatccttatcctgctgggtgtgagggttcattcatataaaccaggagatatggtgtgggtaaaagattggaaaagtaaaattcttcaacctattttggccagtccatatactgtgttactaaccacccctactgctgttaaggtctcaggtattcttccttgaattcatcacactagggtgaagactgctgcagaaaaaaacacctcctggaaaatagaaaaggacacagaccagccactgaaactcacccttaaaaaacaagaagaaaaaagacttcagctcagagcattgtgcaactactggagacaaccctgctgctactaggatatctaaaccaagtgaagacccaggaaaacatcttcatgtcatgggcccactcttatgcaaatgttcacaactgatccagccactgagtaagtggagccctgccaatgtctgtaatggatggactaccctggtagattcacctttctgtcagggtgatttggccaatttatgtgaatttttacatctgtttttcagtggtatgattacatggcaaccacattttttccatcaccagggactacagacatcatgatgagggtagaagctttaactgactttaccaagcaagatttaatagatgaaaagaaagctataatggcattaaatactgaacaaatgctaatgagaagaattgtcattcaaaatacaatggcactagacatcctaacagctgcccaaggaggggcatgtgccatcataaaagtagaatgttacatatatattcctgctctctctgataatgtaactgctacattagataatatgagaaatcaggttaggacaatgtcgaatgataatcttcctttctggacttctgttttgtcttggataaaaggggactggtggaaaaatgtaatactaatcatagttattacaccgctattattaatcttcagactttgtatttttaattgtgttactcagcttgttgcatcccatttaggaataatattccaagcccaactcctcaggtacagtatttgccaatgactgatgcacatcagaaaggatgagcctcaagaggggggaatgtatgggtgtgggaaagggaatagggaacttgaaaagagcaaagccattttgctgccactgtccatcttggtgaacttaaggtgactcataagagggctctgagaaaaacaaagtcattaggacttgagaaattccaaccctgattgttctaaagaaattcaaaaatagctagattgtacttgaggttaattattaaagtaactgcatgtaactaaagattagttagacatgtaagcaagcactataaatgtactccccctttttgtttggggtccatgattgggaagtgattccccatggacctgcctgcataataaagctgttctccatcttccttgaatgtcctctgagatgatttctgggaattctaca

SEQ ID NO: 168 - DNA, 5219 bp, artificial
  ss1339 sequence
tcagaggtactccaggagtccgatgagagcccaaggcaaatctatgagaggctatgtgaggcattctgcctctataccccctttgacccagaagccattgaaaaccagcagatggttaatgcagcctttgtgacccaggcgcaaggagacatccaatgcaagctccagaagttagagggctttgcaggcatgaatgctagtcagttcctggagatagcagacagagtgtttatcaattgtgagcaggtggcactaaaggctaaaaacaaaaaaatgaaaaaaaaaggtgagaactgccactgccttggtaaaacaaatggaaggtgccccatagagctgatgtcagaaaggggggcaatgaggaggaccatctagcccagggccaaaacagggatggaacaaatgtgcccactgtcatcaggaaggccactggaaaaatgagtccccccaatggtcagatgattcccaattgggccccaagcagaggggaagaggccaggtggtctggggctgatatcggctggcccagaagtgacatatggcccccaaaaatgattgtgtaggactgaccactatgggaggctatgaggaaaacaaggaccaacaggtctctattttgctaggcccccaagagcttatggtccaaatgaatataggggaccaacccattgacttcatggtagctactggggcagaacactcagtggtaactcagcctgtggtcccactcttgcagaggtaagccaccatcataggggccacaggtaatagaacattgtaccccttcctactgcctagatgatgcactcaaagttattcacaaatttctatacttccccaactgtcctgtggctttgatggatcaggacttactgggaaagctacaggcccagacaactttcaactccaatccccaaacagccctgaccctagggaggctggggcagggcccatacaatgaaagcaatatttcatccctcctaagacccagatgggaattcaaaggcacctagaaaagctttgaaagtatggaatcctctgaccttgtcagtcaccttggaacatgcctctcctgcaggtccacaagccaggtaccaatgattatccgatgatccaggatctgcatgcagcaaatcaagccacagtcaccctatatctggtcatcctaaacccctacacattgtgtgtccatctggcctcccagagtcaatcgatttttgccttccagtgtaaaaatcctgagaatggtaacaagggccaattgacttggaccagattgcctcaaaggtttaaaaaatctgcaactacttttggtaccacattagcctctgatttaaaagccttcccagaaaagcagtatggctctgtgctgcttcagtatgtagaccacttactactggctgggaaaactcagaaaaattgtacagaagggacatgtctgctcctcaccctcctatgggaggctggctacaagattgcaaggaaaaaggcccagatctgtcaagaagaagttaaataccttggttttcacctatccctgggacaacatcaatttggcctggagaggaaacagactgtctgctcaattccagttccatccacctgacaccagtttcaagaattcctcagggccacaggtttctatagaatctggatactcaacttctccattttggcaaagcccctttatgaggctacaaaggggggataacgagaacctctgttgtgggaatgagtgcaacaaaaggtctttgaagaaattaagtgggccctcaccaatgcatctggcctagggctccagacatggtcgagccattcttgtacatacacaagcacactagtgtcagggtaggggtcttaactcaaatgtttgtgtcatggcatcttctgatggcatacctctctaaacaatgtgactccattgcccaagggtggccatcctgtctgtgggcacttgcagccacagctctcttggtgtcagaagctgataaattaactatgggacaagaactaacagtccaagtgccacactcagtactaacactaatggagtataagggacaatactggctgattaactcccggatgttatgtaaaaacccattcatttgtctagaggtagtgaggaccctaaaccctgcaaccctactacctgtcaggctgggccagcagatcttgattgtgttaaagtcatggatgaggtattttctagctgattggatttaacagaaaagcctctcaaagacccagatgtcgaatatttcactgatggtagcagctttgtaaaagagggaaaacactttgctgggcattctgtgatgaccctactttctaccactgaagcaaaagatctaccaaaagggacttctgcacaaagggcagaacacatcttgttaacctgagccctccaactggcaacaggaatacacttcaatatatacacagattccaaatatgccttcactactctccatatgcatagggctttatttatataaagaaaaggggctaatcaactcaggggggaaggacataaattatggcaaaaaaatacttgaactcttagatgctgcatgggcccctggaaaggtggcattcatacactgtcagggacatgaaggggggaacaccacagttgcttggggaaaccataaaccaagaagcaaaactcacagcctccaaggggacaatagaaccagtggctctgactgccacactgttccctagtccattggcagaatgggatcctaactactcatgacacgaaaacacctggtttaaaactaaaaatggaaaccatctcccagggggatggtggaaatctgaagatatagcaattccaaagtctggggctagggccaaatagcaattcctgaggccctagccccagactttgtcaaataatttcagcagtagacttacattttctaaacagctcttgagaccacattgggctgacacttctacatccctcagctttctagcatagcacagatagtatgtgaaaaatatgaaatttgcacccgaaataacccacatcaggggcctagggccacccctgaaatatagagtgttggaggggcctcattcacaaagatagttgtggacttcactgaacttccctgagtctaaggctgtaaatatctgttagtctttgtgtatactttctcagactggatagaggacttccctactcatacagaaaaggcacatgaagtggcctcatttcccctaaaggaaatcaattcccaatttgggataccaatcaactttggattggataacagagcagaatttgtggctgaggtggtgaaattagtggcaaagaagttgaatatcacctgcaagttacacacagcctatcggccccaaagcgctgggaagatggaatggatgaatcagactctgaaactgcaattaagcaaactatgccaggagactcacttacactgggaccagctctagccaatagactgctaagaattaggtccagccccacgaagtgaacagggttttcccctcatgaaatactctatgggtgtccccctcctctcattaaggatataaggggggacttaaaggaattaggaaatctcaccttgaggcagtagatgcaggcactaggttccacactggctaccctccatcagtgggttagggaacagttacctgtaagcctaaccacagacacccacctcttcaaaccaggggatgatatatgggtaaaataatataattctggcaattaaaacctctttgaagggtgccatttagtttcactttatccacccctactgcagtaatggtggcagaagtggctccttggattcaccagagcagagtaaaacccacttcccaagcctgggaaaacacttctgatccatcaacaccatgcaagctgaccatccagagaaaacagattgtgaccccagaaaacctcaaggactgcagccctgttttagtaactccagaagctgactaatctatgcatggcagaagcttgaggaatcagctccccaatgggataaatagactgtttttgtttcccatttccattctcttactatgatgcactgccaccccttacacctgtctattattgtgatccttgccctgatatttgccatagggttggcagagactgctctagatgactggaaaggtgacaaaagaccagggatgatgtcgacacagacattgagtggcaggccgcaggtggactacactggataggtggaagaacaacctatactgtactttccccaaattgtcagagtcttatatgttggggttgatctgcccatctttcttcttgctcctacttgccagaggggaacatttgggagtccaactgtatgaggtctggaagactcagagaaaatagtgtgcccagcaaactggcaactgaaaatatgacaaatgccccctgagtgtatatccatttctatggtccagccacctgggcagaggtcaggtcttactcccatctatgtgttaaactgcatcatctggttacaggtcattgttaaaaattttgtttgagtgctggttttcaacttttgggggattcaaaatcctcaaaggtgttgtgtttttaatttggagggctttcctgatcgtatcctgtctagcccccagttatgagatctgtcttcaagctcactgagtccatggtaaaagaaaaacagcacacacgtggtgatgctacagaaatataaaccctaaaccaagatgatgctctttgacctcaaagggagtccaagcatcaaagggtgaaatgtggtaggggccctcccagaataaagagaaggcaatgtatacaatcagcatctgtatatacatgagcaattatgtggcagtctgacataatccatatccacatgcaactttgtagcatagaccatctaatcagaatttacagaatgtatgttaccttataaggaggataaagggaccaaagggaaaagaaaaaaataaaggagggtatataagacagcaccccactaagtttggggctcagcctctggatacagatccactgagccagtgccagcatgaataaatgctgcttccttgcaaaatgccttggtgtcctgtctccctgtatgagaatcctgcaaaaatatgtggaatccaaaatatgacacaaatgcattttcaaaaacagactcacagatatagaaaagagacttgggtgccaaggggaagggaatgggatg

SEQ ID NO: 169 - DNA, 7236 bp, artificial
  ss1491 sequence
aaaattatgatggctcaaatgatggcctcctcaaaatgccgactggaacccgagaagcccattttatctggggaaccagaggaagttcccccaccttattgtaccctccactgccacccacacttccagctgcctcccctgagagcgccccctccctgactcacccaccagtcgctgcctgtcccgagcctccggtgttaaccccatatactccagccaaaggcaactggaaagtcaggccagcagaggcagacccgcttcactacactaccagggagccttgcagataccactgagagacactagagggcctatttattttgatcaggaaggccatgttcaaggaggccagtgcgtttctgagtaccaacccttcaccaccattgatttcctaaattggaaaaatcctactccctcctatacagagaagcttcaggcgatgagatgattgatctaacgcaatccatcatccagacccacaggcccatctgggctgactgtcgccaactactcctgaccctactcaacactgaggaagacccccaaatcactcaggccgctttaacatggttagaagaacacaccctggccgggataataaatgcacaggcttgagcccagagccagttccctgaggaggatcatcactaggaccctaatgatgctcagaaatttcagatgctcgagtgttaccaagaggctcttttaaacagcatgaaggaagtgggaaaaaagactacgaataggagcaaaaccacagaggtgctccagggacctggagagagccccagtcaattttaggagaggctatgtgaagcattccgcctttacaccccctttgacacagaagccaccaagaatcaatgaatggttaatacagcctttgtcagccaggcccagggagatacccaacgcaaactgcagaagttacagggttttgctggaatcaatgcccagccaactattagaggttgcatcaaaggtatttgtcaactgagaccaagaagcccgatgagaagcagatggataaatgaagaagaaggtaaaatctactcactgctgccctgctagatggattagaacactcccggagaggtttcctgctgagtcagggccaaggtcagggaagaaaccagcgaggtggaccatctcgcccgagcccaaaactgggacggaaccaacgtgcctactctcgccaggaaggccactggaaaaaagagtgcccccagctgtcagatgattcccaaacaggcccctagcagaggagaagaggccaggtggtctggggctaacatcagctgacccagcagccacctggagcccccaaaaatgattttttagggctggctgctatgggagactatgaagaggactaggaccgatcaggctctactttgctaggcccccaagagcctatgatccgaatgaatgtagggggccggcccactgacttcacggtagatactgggcagaacactcagtggtaactcagcctgcgggcccactctcacagaggcaagccaccatcataggggccacgggcagtcgaacacaaagccccttcctgctgcctagacgatgtactttggggggacatgaagtcattcacgaattcctgtatctccccaactgttctgtggctttgatgggtgaggacttattgggaaagctacaggccagataactttcgactcccacagccaaacaaccctgactctaagaaagccaggggcaaaggtcatgactcttaacggttccccaaggggaagaatgacacctctacggtcttatagagaggccacacagggacctgagcttccctttaaactacctggggtatgggctgaagaaaatccccccctagactggcccaaaacatacccccaatagtagtagagctaaaaccaaggtcaaacctgcccactaaaagcaatatttcattccccacagagcacaaatagggatccagaaacatctagagagactcctgaagtatggaatcctccaaccctgccagtcgtcttggaatacacctctcctgctgcttcaaaaaccaggggcagacgactcccggccagttcacaatctatgagaaataaaccaggccaccattaccctggcacccagtcatccctaaaccctacactctcctgggccttatccccgcagaggttgccttctttacacgtctgtacctcaaagatgcctcttctgcatctgcctggcccctccaagccagccaatctttgcctcccaatgggaaaatccagaaaatggtgacaaggcccagctaatctggactagatagcctcaagtattcaaaaattctccaactatctttgccaccacattagcttctgatttaaaagcattcccagcagactagtatggctgtacactgctccaatacgaagatgacttactactggccagacaagctcaggaaaattgtatggaagggacatgtctgctcctcaccctcctatgggaagctggctacaaagtttcaaggaaaaaggcccagatctctcaataaaaagttaaataccttggcttccacctattccaaggtcaacgtcaactcagcccagagagaaagcaggctgtctgctcaatcccagttcaagaatttctcagggctgcaggtttctgtagaatccagatatccaacttctccattttggcaaagcctctttatgaagccacaaagaggggagaacgggaaccagggcaacaaaaggcctttgaagagatcaggcgggccctcaccaacgcgcctagcctgggactcccagacacctccaagccttgcttcttgtacgtgcatgaacatactggtgttgtggtaggggtcttaactcaaatgctggggtcatggcattgtccagtggcatacctttccaagcaactagactctgttgcccaaggatggccactctgcctgcaggcacttgcagccacagctctcttagtgtcagaagctgataaattgactatggaacacacttggtactgacattaatggagtataagggacaatgctggccgactaacacccggatggtcaaatatcaggggatgttatgtgaaaacccacgcatttacctagaagtagtgacgttactacctgtcgggccagatcagccacattatgattgcgttgaagtcatgggtgacgtattctccagttgaccggatttaacagaccagcccctcaaagccccagatgatgaatatgtcaccgatggcagtagctttgtaaaaaagggagaatgccttgctgggtattctttgtaaaaaagggacttccacagaaaaggcagaactgattgcactaacccgagccctccacctggcagcaggaatacatgtcaatacataactgactccaaatatgccttcaccaccctccatgtacatggggctctatataaagaaaaggggctactcaactcagaacaaaaggacataaaatatggaaaagaaatccttaaactcttagatgctttgtgggccctgagaaaggtggcagttatacactgttggggacatcaagaggggacagtggtcactcggggaaactttacagcagattgaaaagcaactcgcagccaccaaggggacaatggaaccagcggctctgaccaccacactgttccctagtccattggcaaaatgggaccctaactactgaagacatgaaaacacttcgtttaaaactgaaaatgggaactacctcctaagtggatggtggaaatttgaagatggtcgaatagctattcctgaggccctagcccagcctttgtcaaacaatttcaccaggagacttacattggctgaacggctcttgaggccacattgggccagcatttctacatcccttggctttccagcatagcctggggaatatgcaaacaatatgaaaagtgtgtccaaaatgacctgcatcagggacctagggccacccctggaatacagagtattggaagggccctgattgaaaatatagttatggacttcactgagcttccctgagtccaaggttataaatgcctgctggtctttgtgtgtacattctcaggctgggtagaggccttccctccttgtgcagaaaaagcacctgaagtggcctgacttctcctaaaggaaatcattccctgatttggaatcccaatcaccatgggatctgatactgggctggcatgcatggctgaggtggtacaattggtggcaaaggggttgaagctcacctggaagtaacacacggtatatcatcctcagagctccaggaaagtggagcaaatgaaccaaactctaaaattacagttaagtaaatagtgtcaggagacccacttacactgggaccaactgttgccaattgctctgttaaggattaggtccagccctactaaacggacagcattttctccgcttatgaaagcctttatgggcgtctccctcctctcattaagggtataaggggggacttaaaggaattaggaaaccttaccctgaggcaacagatgcaagcactaggttccaccctggccaccctccatcattgggttagggaacggttacctataaacctaaccgtagacaacaaccccttcaaaccaggggatgctatatgggttaaaaaaaatgggaatagccagccattaaaacctctttggagggacccatttactgttattttattcacccctactgcagtaaaggcggcagaagtggcttcttggattcaccacagcagagtaaaaccagcatctcaagactaggaataggtccctgatccctcaacaccatgcaagctgaccatcccaaagaagcaagctgtagctccagagacccatgaggacgacagccctgctttagtaaccctggaagctgactcatctatgtatggcagaagcttgaggaatcgtctaccacacgggataacagactgtttttgtcccccatttcggttctctcactgtgattcactgccaccccttgaacctgttagttcagtccttgccctaatctttgccatggggttggcagagactgctccagccaactggaaatgtggcgaaaggttcctgatagctctctctttcctcttgtgggtaggatgcttagttgttattggttgcctctgatatgggctcccattattattattatcattattattttggtctttttagggccatccccgaggcatatgtaggttcccagactaggggtcgaatcggagctgtagccactggcctacaccagagccacagcaatgcaggatcccagccgcatttgcaacctacaccacagctcacggcaacgccagatccttaaccccctgagcgaggccagggatcgaatctatgtcctcatggatgctagtcgggttcactaaccgctgagccacaatgagaactcctgggctcccattattgacccaagttccccaacttgtgatccatgcatctgcactacgtgacatggccagggtatcacaaagcctttgctttaccacacccattttgcttgtcagggaagaatcttggggacatgcaaccacaacaggaccacctactccatctgccagcaggggaatcaatacacttgtttcgacccacagtattcccctactaaggaatggttagaaatccaacactcccgagattagccctcccaagaagttcagctcatcagtagggccaaaataatgaatccccacctgcctgtgtcaatgttgtttgatgtctgcaaggccactggcaacacctggtcactttacactatactatgtgggggactacagtgggaatgagagtactgcctaaatgattaatatatgtgcccagaatgtggggaagacgcttgctacaagctttgcccatcctggaataatgttgcctgggctacctgggaaaatacgtggaaactcccaggtgatgatacagtactcctccaaaagggtacagctgattccaactgtaaatcgggagcctgcaaccccattaattttactattctgacccaggagaattatgatggaaacagggttacggagtcagtatatgtacagatggatgaggcaaggatctcagaacccaactgtattttaaaagggtcacaattccgcttcaagcctcaactactcaagaaacctctcattccttttatgagacaatagaaaggagccctccccccatccccatcacaacaacaaaaatactctgtttctggtcttgacagaaactacagccctgactctaaaggcgtcctcttgctatgcatgtggaggaactaatatgggagatcaatggccttgggaggctagagaactggatcctcatgagccctacacagaaacaagatgcccagctctgacactgggatatggcttctcaaaacctcagtcatagggaagaattgtcctgcctgatggggaggacagtttaacactactgttgggagtctgatgtgcccgggccaaagattctataatgcaactgctcaaaagacccagtggtggggatcctcaaaccatcctgaatccaatcctcaccctttgtctaatttctctcatctccaaaaggcctgggatgagactgatacaaataccgaatggtgggtcccaggaaggctacactggatatgcgggaggatagcctacactgtactttccccatactggtcctgtttactagggtctattcgcccatccttcttcttgctcccactggccaggggaaaacacctggggattcaactgtacgagggcagagggacccaaatggaaacgacgtgccttaacagattggcaactggaaggatgacaagtggcccccagaacacagtccaatactatggcccagccacctgggcagaggacaggtcttaaggataccatactcccatctatatgttaaactgcatcagcaggttataggaggttgttaaaaatttgtttgggaaacagttttcaactttcgggggattggaaaccgccacaagtgttgtgttttcaatttggggggcttgcctcatatcctaccctgtctaccgcccctagttatgaggtctttctccagcctcattgaggccatggtcaaaaaaaaaaaaaaaaaaagtccacacatataatgaggttatgaaaatataaacccctaaaccaaagggggctccgagcatcaaagggaggaatgcggtaggtagccctgccagaatgaagggaaggcaatg

SEQ ID NO: 170 - DNA, 9401 bp, artificial
  ss1472 sequence
  misc_feature (802)..(901): n is a, c, g, or t
  misc_feature (962)..(962): n is a, c, g, or t
  misc_feature (964)..(964): n is a, c, g, or t
  misc_feature (1017)..(1017): n is a, c, g, or t
  misc_feature (3237)..(3237): n is a, c, g, or t
  misc_feature (3241)..(3241): n is a, c, g, or t
  misc_feature (3278)..(3278): n is a, c, g, or t
  misc_feature (3326)..(3326): n is a, c, g, or t
  misc_feature (3331)..(3331): n is a, c, g, or t
  misc_feature (3342)..(3343): n is a, c, g, or t
  misc_feature (3365)..(3464): n is a, c, g, or t
tgaaaaacactgttactttagggatccctgctcttaggaaagatccagccttccgcagagaccccaaatctgaggaaaacacagccccttacttcagggaaaccacattctgaggggagacacagccgatcctcagacggcctgtgtctgaaacacagcccttcctcagagaggctgaactggagggaaataaacactgtctgcagagaggcccactctgaggggaaatatagctctgtcctcctggagccctagtctgaggggagatggagccctttctcagagagcctaaatttgagagaaacagccattcctcaggagcatgaatctgagtggaaaaaacacctttccttcaggtatccttatttttaggggagttccagcccttcctcagagagcccaaatctgaggaaaacacagccccttacttcagggagccacattcgaaggcgagataccatcctgcctcagggagccagcagaatctgagggaaacaccaccctgaccaggggagactctgaggagatataactctgccttagggagttccactctgcgctgaagaacagagccctacttcaggaaacccaaggctgagggggagaaactgacctgaaactgacctcttggagcctttttcagggggagataacagccctcctcaggaagcctgaatctgagggaaactcagtccttcccagtaggactggatctgaggggagatactcccctaccaaggggagcctttacaatgagggagcacagccctgcttggacagcacagtcttggggggaggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttgaatatataaaagagaaagatttgtgtgggagtgtgagttgttttgtttgaagtgtntnagagagagagagagagagagtaagaagattatagataggagagttgagtgtgngggtgagatatgtatgtgtgtgtgtgtgtgtgagtgtgaaggagagagagagagagtgtgagtgtgtatgagtgaaagagggggtttgttttgtgatagtggtatatagagatatgtgtgatttgtgtgtgtgtgtgtgtgtgtgtgtgtgtgtgtgtgtgtgagagagagagagagagagagagggagagagagagagagagagagagagagactggagagaacgagagcttgtgctccaccgtccttggactacggagtcagagtgagtcctaacctgcagttccgcagcgaccctcatacagcttatggtggccctctttggagggatcttgacattggggtttatacagtcccacctatactaagaggcgcctgaaatatctcctccgggggagtggtcaggcggacaaagtgattgttacctgaggccttgtcctcactgtttgtcttgcatcactgtcacagggtgggactttacacaatgggtaaatcggcttccaagcccactgtcttagagtgtatggttaagaattttaagaaaggattttctagagattatggtgttaaactgagtcctggaaaactgtgtaccctctgtaccctagagtggccctcctttggtgttggctggcctctggaagggaccttagatgagttcacagttgcagcagtatataatgttataacaggagaccctggacacccagaccatttccatatattgatcaatggttggaaattgcctatttgaggcccccatgggttcggttctgcaccacagaccagggacagtgtagggtgctagtagcccagtccaagaagaaaaccttgtctcaaaaaaaggtgccacctatttttcaaggggaacctgaggactcgccccctatgccaccaccttatgtgctgccagccccacctctgggagccgaaggtccccagatgccagatggcccaccgccttctgtttcttctcctccttctgcttctgaagttcccaaggcaatgtcacccccacagccagattctccagaaccaatgagcaggcgcctccggtcagctcagggagcagccactccagcattgcaaatgcccttacgggagacacggggaccactgcaagttgcccccaatgggaccatacaagagggaggacgagttttttattaccagcccttttccactgctgatttcctcaactggaagcaccatactccctcatattctgaaaagcctcaggcactgattgatctcttagaattcattttccagacacactgtcccacctggatagactgctggcaactcctttttactctgtttgacactgaagagcgctggcaaattgtaacagaagcccaaaaatggcttcaggccaatgtggggggtcgagcagacttggcaaactgggtaagggaagccttcccagaagaaaacccccactgggactatgacactgaagaagggaaacgtaacctagagaggtaccagcaggccttcctacagggggcaaaaactggggctaaaaggcctactaatgtagctaagaccagtgagatactacaagagctgaatgaaagcccagccaaattctatgagagactatgtgaggctttccgaatctacaccccttttgatcccgaggctcctgagaaccaacggatgataaatgctgcctttgtgggacaagcccaatcagatatctgtaaaaagctacagaaattagaaggatttgcaggagagaatgacactaaactgttggaaatagccaacaaggtttttattaaccgagaccaggtggcccgccgtgatgcagaaaagagaatgaaacaaaaagtgactcttctggtggctgccctgtcaaaaccggtgcccccagtgggaccaccccataggggacaaggcccaaggccaggggaaaggagtcccctggaacatgaccaatgtgcttactacaaagaaaagggacattggaaaaatgaatgccccaactgtcctgagaaaaagaccaaggcccacctagccagtactgatctaagccattcagcaccaacctgatcggcctagctgagtctgattggggggaccaggctctctccaactgggcccccgaaagcctatggtcagaattcaagtagggagccaccccatagactttatggttgacacaggtgccaaactttctgtggttacacaacctgtggctcccctctcgggaanaganaccaccatttgtggggccacaggtaaccaaacccacnaacccttctgtggtcctcgatgatgtcgatttagaggccatgaagtantacantaatttctttnnactgctgactgccagtcccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttatcatggctcttgctgtaaaaagggaagaaaaatggtgcttgtactctcccccttcagaaatggggaccattccccagaactagagactaaatacccattggtttgggctgaaggaaacccaccaggactggcaaaatgccatgctcctgtcttgattgatctaaaccccggagctaaaccggtaaagctacaatactcaattcccagagaagctcgactgggaatccaggttcacctggataggcagcttcagcacggactgttaataaaatgtcagtccccttggaacacccctttactgcccataaaaaaacctgggaacacaatactaccgcccagttcaggacttgagagccataaatgaagcaacagtcacattacacccgtccgtccctaacccatataccctgctagggctgatcccctccactgctgagtggtttacttgcctggacttaaaagatgcctttttctgcctccaggtggcacctgccagtcagcccttgtttgcttttgaatgggaaaatccacatacagggacaaaggaacagctcacctgaactagactcccataaggattcaaaaactctcccactctttttagcggcgccctagccgctgatctggctgaatttcctggacaaaaattgggctgtgttttactacaatatgttgatgacctcttactagctggcactacggaggctcagtgcctagagggaacaagagctctcctttccctactgatggaggcagggtatcaggtttcaaaaaaaaaaaaaaaaaaaaaaaaaaaaagcacaaatctttaaaaaacaagtcaagtatctgggatttaacatcatgcagggctgatgaatgctggggactgaaagaaagcaggcagtttgtgccattcctgtccctaccacccgccagaaagttcgtgagttcctaggggcagcaggattctgccagatatggatccccaggttttcagacttggccaggcctctgtatgcagctctaaaaggggaagaaaaggctccccttgaatggggaccaagccaggaggcagcatttcagacaatcaaaaccaaactcactgaggctccagccttgggacttcctgatgtaaccagagaatttaacctttttgttcatgaaaaaaaaatgggatggctttaggagtcttaactcaaaaatttgggccttggcagagggcagtggcatatctgtctaaacaaattgactcagttgcagccggatggcctccctgcctctgagcactggcagctaccacctttttggtgagagaggctgacaagttgactctgggacaaaacctcaatattaaagtcccacactcagttgtaaccctgatggataccagaggccaccattggctcacacatgcacgaatgactcaatatcaagggttactatgtgaaaatccacgggtaaaactggaggttgtacgaactctgaacccagccacttttctgccagatgaagcagggcccccagaccataactgcttggaggtactagatgaggtattttccagcaggcctgacttgactgataaaccactccaaaatcctgacctggttttatatactgatggcagcagctttatggaggatggaaaaagatggcaggatatgctgtggtatctgacttaaaagtgatagaagcagaggtgcttcaacaaggctggtcagcacagagagcagaattatgggccttaaacagagcactggagctcagccaagaccagtgagttaatatctatactgactcacggtatgcctttgcaactttgcatgttcacagagccttatataaagaaagaggactcctcactgctgaaggaaaagggattaaaaacaaggctgaaatcttaaagcttctagaggcagtatgggaacctaaagaagttgcagttatccactataaaggccaccaaaagggagacgacccagtgacaaaaggaaaccgtagtgctgatgcagctgccagacaggcagcccggggacaacagccagacaaacctaaggtcttgctggccccagaagtgccagctgtccccagatattctccagaggaagaaaaatggataagggaggaaggaggaactaaaactagaacaggatggtgggtcacacgggacgaccgagtttatgttccagaacagctggcctacaaaccggtccaccaacaacacgagctaacccacatgggcaaaactgccttagagaccctactgggccggtactatctcattgctcgtcttcctgcactctgctcctctgtctcccaaagatgcataacctgtttgcagaataatgcctgccaggggcccaacagaccagctggggcacaacactgtggactgtccccatttaaggatatggaagtgaacttcactgaggtcacccctagtaaggggtacaaatatttactaatttttatctgtactttttcaggacgggtaaaagccttccctacccaaactgaaaagacaagggaagtaactaaggcactcctgagagacattattcccagatatggaatgcctctgaccatcaggtcagataatggactggcatttgtggccaaaacagtacaacaggtggcaaaagctttacagatccgacggaaactacattctgcttattgccctcaaagttcagggaaagtagaacacatgaaccagacccttaaacagacactggcaaagttatgtcaggaaactggcttgccctgggtagacatgctgctggtggccctcctaaaagtgagatgttcaccccgaacagaaatagtattcttgccatttaaaatattatatgggaggccacctccactaatcagtttaaaaggaaacaccagggagttgggagacttggaattatgcaaacaattacaaggaccggggctcactatttctcagatacataaatgggtcacagacagaatacctgtgtccttaggtataacagtacacccccacaagccgggggaccaggtgtggataaaggactggaataaggagcctttgaggccggtatggaagggcccctatactgtaattctaaccacccccactgctcttaaagtaacaggaatagtggatccatcattccagagttaaaccggctggccctgctgatgaccgtgaagagtgggagactgccctcaatctggagagacctcttcgcctgacaatatagaggaggagacgatgatctcaaagccctgctctgaccacaccggaagctggtcagtcaatgcatggctgaagcttgaggaattggctgcctggtaaaataaactgccttacctaccttccacaagagactttcttagtgttatatactgttatcttatgaccaatgtatgtttgctgcctgttgctgttaatctggtcccctttggttctgccaggattcacttcctcatgtgaccaatgcattctagtgaaccgatcagattaaggggttacatggactttgctttactccactcatttctctgtttctggagaaattcatggaagttgtactcacaacaggaccacttattctatctgccaacagggggaccaatatactgccttgatccacgatactcaccaactgaggaatggttagaagtcgggtgctctcataaatcagggcagctaattaatcggacccaaattaccaaccccaatttgccagtatcaatactttttgatgcccgtgaagctatgaatgggtcctggacttctactagaccatgtggaagcccgtcatgggaaagagaatataggctccagcataaatatatgtgctgggggaccacctggagcggttgccaggaatgcacttactggagctgtgtgacctgggcaacctggaataagggagacaaaacagctgtccttcaaaagggtacagcccctccagactgtcagacaaaagcttgtaacccattgacggaagaggcctagaccctggagctgtgctacatttccagagaatcacgtttgcactccaaactgcctctcacagggtctttcattccttttatgaagagataaaaaacaccccacctcccattctggccacaactgagaacttattcttagccctggcagaaactgttgcacaaactctcaaggtctcctcttgttatatatgcaggggaacgaacacaggagaccactggccttggcaagccagagaactggacccattagagcctcataatgagactgcatacccccaactcaccaatggggtatggatcctcaggactgctatcatagggagaaattgtcttgtgaggtggggaggacggtttaatgcttcatttggaagcctaacatgtttaggcctaaggtattataatctgacttcccaaaagactcagtggtggtcatcctccaatctctcagagcccaagcctaatcccttgtccaatttttcccacctccgacaagcatggaaagatatcagtgctaatatccaatggcgggcaccaaagggattatattggatttgtgaaaaaatggcctattccatacttcccccgaattgggctggggcatgtgtactgggaacaatcagaccttccttcttcctgctcccactgtcactaggggaacaactgggagttcgtatatatagggcacagggtgccagagagaccggagggctctccaaattggagactggaaagatgatgaatggcccccagaaagaataattcaatattatgggcctgccacctgggcagaggatggctcttggggatatcgcacccctgtctatatgctgaaccacatcatcagactacaggcggttttggaacttataacaaatgacactgcaagggtcttgactatattggcccaacaacaaactaaaatgtgcagtgcaatctaccaaaatcgcttgaccttggattatttacttgcttctgaaagaggggtttgtggaaaatttaacttaagtaattgctgtctacaaatagatgacactgaaaaggtggtaaaagaaattgctgaccgcatgactaaacttgcccatgtgcctgtacaaacttgaaaaggatgggatgcagacagtctctttggtaaatggttctcttggttgggagggattaagacaatggtagggataatcatggttatactcacagggtgcctacttgttccctgccttgtacctctcctgataaatattataaaaggttttataaaaaccacggttgaaagaaaaacggcctcccacctgctacttatcagaggctacctaagggttatgattgatgatgatctctaaagggtgcagatgcaccctgaacatcaagaggggggaatgaaatagagttttaactaaagaacaaccccccttggctaagaaggcagctgcaagcctttccagctatgctcatcactataccacccttcttgtaataatgtaacaactgtgtgccctctgtccaagccagcagccctgctaatcaggtacccagctttgcttatcagttccgcttctgtaaccttgcttgctcagtttcttagggaggaacactgtctgcttggggatgaaggaggtctgggatgcttacatgggaaaatcaagaccttgtagtgtataaaagttactgagaccaaagacctggtgctcagactctggaggtgactcctctgagcccgcaccagtgctgaataaaccttacttttccatatctccgagtgctgtttgtctccttccacggtttttgcagtttccgcaacagtatgaatctgaaggggagaaataaaacactttcttttgagaatcccccttcttagaggagattcagcccttccacagagagcccaaatctgaggaaaacacactcctttacttcagggagcttatttctgaaaagagatacagtcctccccaggaagaca

SEQ ID NO: 171 - DNA, 7213 bp, artificial
  ss1509 sequence
tggggatgggggaggtccgggatgcttacatgggaaaatcaagaccttgtggtgtataaaagttactgagaacaaagacctggtgctcagactctggaggtgactcctctgagcccgcaccagtgctgaataaaccttgcttttccatatctccgagtgctgtttatctccttccactgccacgatttttgcagtttccgcaacattttggtgcattggccaggaagccaacaaccgagccggcctcttgtgccaccagtgtcggggaaccaggggaggccacggtcgcccgcccagagacaggtggatagcacgcaccggccattttgccagatccagaccctcactcgggccgtgctggccttggcccacaccgcttcccgaatggactcagaaggagagtggaaacaggttccaggacaggacgtctgactggtgggtgccccagggacatctgcccaagtcaggacccgccatatggcagaaggagagactgatcacctctcagtgaccaaagggtcactcaggtcagggtttgctcccttggaatcgggaggcttgtcaattctggtgtgtgtgtgtgtgagtgactggagagaacgaaagcccatgctccaccgtctttggactacggagccagagtgagtcctagcctgcagttccgcggcgaccctcatacggtttatggtggccctcttcggggggatcctgacattgaggtttatacagtcccacctatgctaagaggcgcctgaaatatctcctctgggggagcggtcaggcagacgaagcgatttttacctgaggccttgtcctcactgtttgtcttgtgtcaccatcacagggtgggactttacacaatgggtaaatcggcttcagagccaatttagagtcttagagtgtatggttaagaattttaagaaaggatttttctagagattatggtgttaggctgaatcctggaaaactgtgtaccctctgtaccctagagtggccctcctttggtgttggctgacctctggaagggaccttagatgtgttcacagttacagcagtatataatgttataacaggagaccctggacacccagaccaattttcatatattgatcaatggttggaaattgcctatttgaggcccccatgtgttcggttctgcaccacagaccagggacagtgtaaggtgctagtagcccagtccaagaagaaaacctattctcaaaagaaggtgccacctatttatcaaggggaacctgaggactcgcccccctatgccacaaccttatgtgctgccggccccacctccaggagccgaaggtccccagatgccagatagcccaccaccttctgtttctcctcctccttctgcttctgaagttcccgaggtgatatcacccccacagccagattctccagaacctaagagcaggcgtctcaggtcagctcagggagcagccactccagcattacaaatgaccttacgggaaacacggggaccacagcaagtcgcccccaatgggaccatacaagaggggggacgtttttattattaccagcccttttccactgctgatctcctcaactggaaacaccatactccctcatattctgaaaagcatcaggtgctgattgatctcttggaattcattttccagacacactgccccacctggatagactgccggcaactcctttttaccctatttgacactaaagagtgctggtgaattgtaacagaagcccaaaaatggtttcaggccaatgcggggggttgagcagacttggcaaactgggtgagggaagccttcccagaagaaaacccccactgggactatgacaccgaagaagggaaacgtaacctagagaggtaccggcaggccttcctacagggggcaaaagctggggctaaaaagcccactaatatagctaagatcagtgagatactacaagagccaaatgaaaacccagccaaattctatgagagactatgtgaggctttctgaatctacaccccttttgatcccgaggcccctgagaaccaacggatgataaatgctgcctttgtgggacaagcccaatcagacatccataaaaagctacagaaattagaaggatttgcaggagagaatgccactaaactattggaaatagccaacaaggtttttattaaccgagaccaggtggcccgccatgatgcagaaaagagaatgaaacaaaatgtgactcttccggcagccgccctgtcaaaaccggtgcccccagtgggaccatcctgtaggggacaaggcacaaggccagggaaaaggagtcccctggaacatgaccaatgcgcttactgcttattggtcatgttggaaaaatgaatgccccaaccgtcctgagaaaaagaccaaggccccacctagctggtaccgatctgagccattcagcaccaacctgatcggcctagctgagtctgattaggggggaccaggctctctccaactgggcccccaagagcctatggtcaaaattcaggtaggggtccaccccatagactttatggttgacacaggtgccgaactttctgtggttacacaacctgtggctcccctctcagggaaagaaaccaccattgttggggctacaggtaaccaaacccacaggcccttctgcggtccttgacgatgtcggttaggagatcatgaagtaatacatgaacttctttacctgcctgactgcccagtccccctgatgggaagagacctgctggctaaaatgggggcacaaatttccttttctactgatggataagcccaacttaaattgacagaaccccctctcctttaatcatggctcttgctgtaaaaagaggaatggtgcttgtactcttccccttcagaaatggggaccattcccccagaactagagactaaacacccattggtttgggctaaaggaaacccaccgggactggcaaaacgccacgctcctgtcttaattgatctaaaacctggagctcaaccggtaaagctatggcaatactcaattcccaaagaagctcgactgggaatccaggttcacctggataggctgcttcagcatggactgttaataaaatgtcagtccccttggaacacccctttactgcccgtgaaaaaaaccaggaacacaggactaccgcccagtataggactcgagagccataaatgaagcaacagtcacattacacccatccatccctaacccgtataccctgctagggctgatcccctccactgctgagtggtttacttgcctggacttaaaagacgcttttttcttcctctgggtggcacctgccagtcagcccttgtttgcttttgaatgggagaatccacatacagggccaaaggaacagctcacctggactagactcccacaaggattcaaaaactctcccactctttttagcggcaccttagctgctgacctggctaaatttcctggacgaaaactgggctgtgttttgctacagtatgttgacgacctcttactagcgggcaccacggaggctcagtgcctagagggaacaagagctctcctttccctactgatggaggcagggtattgggtatcaaagaaaaaggcacaaatctgcaaaaaacaagtctagtatctgggcttctacatcatgcagggccaacaaatgctggggactgaaagaaagcaagcagtttgtgccattcctgtccctaccacccactggaaggttcgtgagttcctagaggcagtatgggaacctaaagaagttgcagttatccactgtaaaggccaccaaaagggggatgacccagtgacaaaaggaaaccatagtgctgatgcagctgccagagaggcagcccagggacaacaaccagacaaacctaaggtcttgaaattagaacactccctaacaccatacacaaaaataaactccaaatggattaaagacctagatataagaccagacactatcaaactcctaaaggaaaacatatgccaaacactctctgacataaacaacagcaacatcttctcagatccacctatcagagtattgacaataaaaagaaaaaaaaaaaaaaaaaaaaaaaaaaaaaacctaaggtcttgctggccccagaagtgccacctgtccccagatattctccagaggaagaaaaatggataagggaggaaggaggaactaaatctaaaatgggatggtgggtcacacaggaccaccgagtttacattccagaacagctggcctgcaaactaatccaccaagagcatgagctaacccacatgggcaaaactgccttagagaccctactgggctggtactatctcattgctcgtcttcctgcactctgctcctctgtctcccaaagaggcataacctgtttacagaataatgcccgccaggggccccacagaccagctggggcacaacactgtggactgtccccatttgaggatataaaagtggacttcactgaggtcacccctagtgaggggtacaaatatttactagtttttatctgtactttttcaggatgggtagaggccttccctacctgaactgaaaaggcaagttcaagggaagtaaccaaggcactcctgagacattattcccagatacggaatgcctctgaccattgggtcagataatggtccggcatttgtggctgaaacagtacaacaggtggcaaaagctttacagatccaatggaaactaccttctgcttattgccctcaaagttcagggaaagtagaacgcataaaccgaacccttaaacagaccctggcaaagttatgtcaggaaactggcttgccctggataaacatgttgctggtggccctcttaaaagtgagatgctaaccccgagcgggaataggattctcgccatttgaaatcttatatggaaggccacctccactaatcagtttaaaaggaaacaccagggaattgagagacaaaattacataaacaattacaaggactggggctcactatttctcagatacataaatgggtcacagacagaatacctgtgtccttaggtataacagtacacccccacaagccgggggaccaggtgtggataaaggactggaaaaaggagcctttgaggccggtatggaagggcccctatactgtaattctaaccacccccactgctcttaaagtaacaggaatatatgcttagatccatcattctagagtaaaaccggctggcacagctgacaaccatgtagagtgggagactgccctcgatccggagagacctcttcgcctgacaatacagagaaggagacgacaatctcaaagccctgctctgaccacaccggaagctggtcagtcaacgcacggctgaagcttgaggaataggctgcctgtgagcccaaatgaaaggagggtttcaaaataagcattcgcattgacagaagaggccttgaccctggagctgtgctacatttccagaaaatcacgtttgcgctccaagctgcctctcacagcacctttcattccttttataaagagataagaaacaccccacctcccattctggccacaactaagaacttgttcttagccctggcagaaactattgcacaaactctcaaggtctcctcttgttatgtatgcgggggaacgaacacaggagaccactggccttggcaagccagaaaactgaacccattagagcctcataatgagactgcatacccccaactcactgatggggtatggctcctcaaaactgctattatagggagaaattgtcttgcgatgcagggaggatggtttaatgtttcagttggaagcctaacatgtttaggcctaaggtattataatctgactgcccaaaagactcaatggtggtcatcctccaatcgctcagagcccaagcctaatcccttgtctaacttttcccaccttcgacaaacatgggaagatatcagtactaatatccagtggcgggcaccaaagggattatattggatttgtaaaaaaatggcctattccatactccccccaaattgggctgggacatgtgtactgggaacaatcagaccttccttcttcctgctcccactgttgctaggggagcaactgggagttcctatatatagggcacagagttcccagagagaccagagggctctccaaattggagactggaaagatgatgaatggcccccagaatggataattcaatattatgcacctgccaactgggcagaggatggctcttagggatatcgcacccctatctatatgctgaaccgcatcatcagactacagacagttttgaaacttataacaaatgatactacaagggccttgactatattggcccaacaacaagctaaaatgcgcaatgcaatctaccaaaattgcttggcctcggattatttacttgcttctaaaggagggtttgtgaaaaatttaacttaaataattgctgtctacaaatagatgacaccagaaaggtggtagaaaaaattgctgaccgcatgactaaaccagcccatgtacctgtacaaacttggaaaggatgggatgcagacagtctctttggtaaacggttctcttggttgggaggaattaagacaatggttggaatagtcatggttatactcgcagggtgcctacttgttccctgccttgtacctctcctgataagtattatgaaaggttttataaaaaccatggttgaaagaaaaccagcctcccacctgctacttattagaggctaccaaagggttatgactgatgatgatctgtaaagggtgcagatgcaccctgaacatcaagaggggggaatgaaatggagttttaactaaagaacaacccctcttggctaagaaggcagctacaagcctttccagctgtgctcatcactatgccacccttcttgtaataatgtaacaactgtgtgctctctgtccaagccagcagccctgctaatcaggtacccagcattgcttatcagttctgcttctgtaaccttgcttgctcagtttcttagggaggaacactgtctgcttggggatgggggaggtctgggatgcttacatgggaaaatcaagaccttgtggtgtataaaagttactgagaacaaagacctggtgctcagactctggaggtgactcctctgagcccgcaccagtgctgaataaaccttgcttttccatatctccgagtgctgtttatctccttcca

SEQ ID NO: 172 - DNA, 4363 bp, artificial
  ss1401 sequence
atgggaggatcccctttaaagccagaaaagaaagaaacacctctaaagtgtatccctaaaaattacaaatttttcaaaatagaagggctaaaaaaggaaaaacttaaattccactcgaacactgtctggcctttatataagttgggaaatggataaaaatggccagaaaatgggtctctaaattaacagtaccatcttgcaattggatctttattgtccaaaggtggaaaaatggattgaggttttccatattcaagtcttcatggtcttttacctgaaccccactctatgtagcttctgtaatcaaaagcctgaggaatcagaaaacattcccgacattttagatgatccccttctaaactccccaacttttgggggaaagggggggggggaacagaactcccctgcttctgtggagcaacccaccttttgggattcctctgaacagtcccaaactccgcctccccatgtccctttatatcctccactgcccctggagggagagactagtctgcagtggaaccccttatcacccaagatcagggaaaacgtgcccttccttttagggaagtggcaaatggcaaatggaaagttaagagtactcgtgcccttctctttaactgatttagcccaatgcaaacagagactgcaccaatttcctgaagacccttgtaagtttgctcaagggtttcaggccctaagctctggcctttgatgtttaacttggaaggatgtccaaatagtcctatctacttgctgtactcctgaggaaaaacagagaatttaggcaacagcccaggagcatggtgaccagcttgtcagggaccaaccctaacattctgttatgggtggagctgcagccccaaatcaggagccctgttggggttgggattacaattcctgggagagaacagaagtcaggaaccatatgatccaatgtgtatcagaagggataagaaagtgtatctacatgccagttaactatgaaaaggttaaaggagtaacccacaagggaaagaaaagccagctcactttaccaacattgatccctcactcctaagggtcaatccctactgggacattttatcagccagtccatccctgatattaggtagaaactccaaaaattacaattaggccccaaaattctgtgtcccaacaactagaggcagtctttggggtatttactaatcgagatcaaggaggaggaagcgagaaccccatgtaaaaacaggcagcccagggctcacattaaatggatggccattactgtcagccatgccttgcaacctgaggatccaagggagccaaggaagcttaaccatctacctggaggtaaaaccggcaagggggaatgcttcaaatgttaagtcgactggccactgggctcaaaagtgccagagagagccctcagatccatgtctggtttgcaaacaaatgggtcattggaaatggattgtccccagttccaaagggaaggaggattcctgcttctgagatggccaagctagactgaggtggcacagggtagcagctccccaccacaagatgactatctccatcaaagagcccctggtggttcctgccatggcaggtaagaaaactaatttttttaattgatttgggagctacttactctgtactcatttctcacactgggcctctttccttctaaagctgtacaatgaccagtatcgaggaaaaacttcatacccattacttcattgggcccctcacttaccagtttgaacacatttgatctcatgtgactttttacttgtgcctgagtgtcctactactcccactactagggagaaaccttctggaatccctcagaaccatattacagctaacaggcctgaagaggccccccatcttgactctatgactaagacaactcagctagaagaacaaggccctattcccagccatattctataagtagtaaaccctgcagtctgggacaaaggaatccccgggtaaggctgtaaatgtctgacctataaaaattagccttaagccaaaggttggttatcttaacaagataaccataaggctagaagcaaaaaaaaggtttacaaccccccataataaattcctaaaacatggtctcttagggccctgtcagtctccatgcaatactcattctgccagttattaagccaaatggggaattcaggatggtacaagacctcaaatcagtaaatgatgccatggtccctataaatcctcttgtggccagtccaggtttctgaagatgcccagtggtttactgtgcttagcctcaaggatgtcttcttttgcatcccagttcatctctcatcatattatctgtttacctttgagtagactaacccctacttgggccaaatgcaacaatatacctggacagtattgcctcaggggttttcaagacagcccaaactgttcacccaggccctaggaaaagaaggggctagtttgcagtatgtagatgatatattaatttgtagccccaccatgaaggcctcagatcagactatcactggagtccttaatttccttggggctcagggctacagggttttccaaaaaaaggggacaaatttcaaggcaacaagttaaatatctgagatatattataaaccctggaagtagacagttatctcccgatagaaaacaagctatattagaactaagcgccccaaacatcttcgtaccttcttaagcatggcagaattttgcggatttggactaatggctaagcccccatatgaagcctctaaaggcccagatatggacccattacacaggactaggaaacaagaaaaggctgttaatagtatcaaacaggccttcaccagagcacctgctctgggtctccacaattaaaaaaaaaaaaaaaaaaaaaatccactcatcttgtatgtagctgaaaagcagggacagccctgggggcctctgtacaaaagctagaagttcctcagccaataggctattttcccaaacaactatattctctggcctctgggcaggagctgctactgagttattagtggaagaacctaacaagcttacctctggacagtcactggaagtccagacccctcatcaagtacaaaagattctggagaataaaggctaactggaggccgccttctcaaaacctgccccaccctcaatccagtttaagcctgctgaaagtcccaaactaacacactgttgccttgaaacccctggctgggtttatgctggcaggcctgatctaacagatcaagccacagaaaatcctaaagaggaatggtttaatgatggcagtagtttcattaaagatagagtcaggagggcagtgtatgctattgtgagtgctcctggtatcacagaagcaaaacctttgccacccagcatgacagccctaacctgagtcttaaccttaggggaaggaaaaattataaatacacacaaagactcaaaacacaccctccctgctatatatacccatgcagctatctgaaaagaaagagaactttttttttttcctttttcctgtttatggccatacctgtggcacatggaagttcccgggccaggggataaatcagagctgccgctgcagattacaccacagccaacaggatccaacctgcatctgtgactaacactgcagcttgtggcaacaccaagagttaacccactgagtaaggcaagggatcatacccacatccccagaggcaacatcaggtccttaacctgcagagccacaactgtaactctagaaagagaacttttaaatgccccaaattcccctgtaaaagatggagctgaggttctacatctcatagaagcaactcaaaaatccaaaacatatctagattccccggccaaggtgatacttgacaaccaattggtcctggattacctattggcagaacagggtgcaacagccaacacttgtaaccaagcaggaccctatggggccttccctaggcaggcccttcccccacatcccctgctttagctcctctctgaagtataatatgtatcttgctggaggtttacaggatcatggtgacctgacctctgtggacagctacaagaacaaaggtatctgcaccaagaagtctgcaataaccaaccaggcccctccctcaccttgcctgtaaaaatgctttgcaattttgactgggggagttcaggatatttgggaggcaccagccacctgtctcctcacttagccatgcaataaacctttctccgctcccaactctgatgtttcagtttgccacactgacttgtgctacctatacgttttattgcacctacatcaaaacctcttgccaaatagaaaccaacactgagaaaattcgacaaaccacctggcttc

SEQ ID NO: 173 - DNA, 6072 bp, artificial
  ss1402 sequence
agacccctctgtgaggcaaactttctcagtgagggtgactgtaagaatttgaaaatttcattaaaaatttttgaaaaactggagttctcgtcatggtgcagtggttaacaaatctgactaggaaccatgaggttgctggttcgatccctggcctcgctcagtgggtaaaggacccggcattgccatgagctgtggtgtaggttgcagaaacggcttggatcctgtgttgctgtggctgtagcatgggctggcggctacagctccggttagacccctagcctgggaacctccatatgctgtgagagcgaccctagaaaagacaaaaaaaaaatttttttttggaaaactgatgaccttatttggaccgaacagtggcctctctctaaagtaaaattgttggctcttcaggaattagtcaaagaacaatatgaacttggacatatagaagaaacaactagcccttggaattctctggttttcattattaaaaagaaaaatggtaaatggtgaatgttgatagaccttagaaaaataagtgctattatggaacctatgggtgcattacaacctggattgccatcacccgccatgattcctgaatcatggcctattattattatggatttaaaagattgtttctatactattccatttcatcctgatgatattacatgatttgcctttacaattccttctattaataataaagaacctgtcaagagatatgtttggaaagttttgccccaagggatgatgaatagtcttacattgcgtcaaaactgtgttgcaaggcctttacacagtatttgaaaacagtttcctgaggcttatattgttcattatatggacgatattttattggcacacctgacaaagaaatattgcataaaaaattttttgagggcagaagaggaattaatatcatatgggtttaagatagcaccagatataaacctcagtatgatgttccttatacttatttgagttatttaatggaaagagaaattataaaaccacaaaaaaattcagatatgaatagaacacttaaaaaccttacatgattttcaggaattattaggatatattaattcactgcatccttcacttggtatacctatcaattgatgcatttatttcaaactttgaatggggatcctgatttaaattgccctagagaattaactgaactagctaaggaataactacaacttgttaatgagcccttacacaaaagacacattgtttgttagaattagtccagaaaaaccagtttctttaataatattaccaaagaaaaattctcctactgccgtcttgtagcaagataagggtccattagaatggcaatatctaacccatacacctaagaaaaccatgaccgcttatcttaacgcttgtttctcaaacactatctaaaggcagaactcatcgtaaacaaatttctggatatgacccttcagaaattatagttcctttgaacaacagccaaatacaacaactttttgtagaaagtatggattgacagattgcctcagctgagtatgttggtaaaatacacatacattatcctaaaaatccaataatacaattttttagtaaacatgaatggataatacctgttaatacaaagcaaagccctattgctaatgccccagtttactttactgatgccaataaagagttcaaggcaggatatacaggacctactatgaagatatgggtctcatcacatcagtcagtacagcaggctgagctggacgctattattaatgttctgcaggatgtgaattcaccccttaatattatttctgattcattatattccgtaaaagtaacaaggaatattgagaccatggcattacctgaaaacactcttaaacccatttttgttttgtttcacatattacgacaaattattcaacgtagaaattttcctttttacatttcacatgtacggtcccattccctgttgccaggacctattgcgcaaggaaatgcacagattgataaattaattatgtactcttctctgtatgaatatcaccaactaactcatatcaatactaagggactgatgcaaaaatttgatatttctcgccagcaagctagagacgttgttgctgcctgtcctgaatggactctaacacaccctcattactcatgttgacactcttaatctacgaggaatccaatcaaatgatatttggcagatggatgttacgcatgttcctcactttggcagaatgggatatgtacatgtatcaatagatacttactcaaatgtcagttttgcctactcccctgcaggagaagcagttaaagatgttaaagcacatttattgcaggccttttcctatatgtgtactccgttaacaataaaaacagataatggtcctgcatataccagttttgctttaaataaattatttcaggactgggatattagacatgtcactgggataccttataatcctcagggtcaagtcattatagaaagagctcataaaatgctaaaaaatactatttaaaaaaggggggggaatgtaggccttatgcccagggaaattctagctcaagcattattcaccttaaattttttagatataagaggatttaatgataaaccggctataatgcatcattttgaatcacttacaagacagcaggttagatataatccctctgctgatattgatgattacacccctgtattttggaaaaatgaaaagggagaatggcttgaaggatacagagtaaaaaaggacaaggttttgctcttatccttacagagaatggacaacatcactgggttaccagaagaaatagcaaagaaaggaaagaaaagaaattggaagagtctagatccacccggggagcctccactacatgccctgaaacgaatgacaattcattcgtcacaggagaaaaaagtcaacaccattgcctcgaatgaataatagtaaaataccacatgggggcaaataaaaaagctcactatagaaggggaaaaactggtgtaagatcagcattaccctttatttatttatttagtcttcttgccttttctgcggccgcttccacggcatatggaggttcccaggctaggggtctaattggagctgtagctatccgcctacgccagagccacagcaacacgggatccaagccacctctgcaacctacaccaaagctcacggcaacactggatccttaacccactgagcaaggacagggatcaaactcgcaacctcatggttcctagtcggattcattaaccactgcgccgcaacgggaactccagcattaccctttaaatgctactatgttatttgtggctataatggcagatttacagcaggtggtaattttgttgggagatcaagtgaatagtttgcaaaaacaagtaagacttaaatgtgaatggaatattacttcattttgtgtgactcctcaccggtataaggaatcatcctttaattgagataaagtaaaacaacatttattaaatcaagggaacttatcaattgatattaataattaaaaaaaagagattatggaaactttctctcagaagttgcatttacttcaaggatctaaccttctggagactgcagctgatggtttattgcaactaaatcccattcctcacttaaagaccattggcggtactatgggaggctttatgttcatattcatatgtctgtttttttgtttctgtacagtctggagatgaatcatgacaaaaatcaatggacaacaacagcaattagccactacagcacttgctaatatgattaataaacaagaatcataaaaatttaaaaaagagggagatgttggcagcatgaatatgcaacatgacgaagaatggaaagaaaagactggtgccatagagtgggtatagaaggtcagtctatacagtctatctcccatgacccttgaggcaaaacgaatgagaacaacatcaaaaaatggcatcttgaaaacaagattgctgaagcactgatgttgctgatggaaaaccatcagctctgacattctcaggactggagccttgggggatttatgggagaggccatagatagcttgaagcaaacaaataattatggtcttggagggctgaaacatttatgattactttatgtgcttaggaatgactgtcctagcatatcttgctttcagtaagttcgaagtaaaataccgatgtatctcctgcacgtacaaggaagtagaaaatagtaaataaaaaccatgagttggctcagagggttgctattgcttctggaaggctgtagccccatgatcccccctctctttccgtgtcttcttatttctgcggcaccgctgacttggggacctgggttgacaagcaggccttgtcattggaatataactgctttccaatgttgtgttagtttcagttatagagcaaagtgatttggttatacatatccatatatccattctttttcagattctttttccatataggttattacagaatattgagcagagttccctgtgcttcacagtgggtccttgttggttatctagtttatacatagtagtgtgtataaactttttttgattgcagagaaatagaattcccagaatgtcaataagactcaaacacatctgctactttataaagaaaggaggagccaagggaaagaaatagcaacatctaccactggcagcaactcccttactgaggcagtgagataaggctgtatgactgtgttagtttatgaataggagttgggattccctcatgagagttgttgctttctgaggttgatagagggaaggggtccttaagatttctgacaccactaaagcaccaaagcatgaacacattttaagatgggtcatgtgattctaagattgagagaaggtgagtaaatttgaaagagccagaaaagtaggctgataccaatttaggcctaatctaaccaacaactggttgttctttcagtcttgctctacctgaattatataaaacgataatatcacaaaagtagtctttgcaatatcatccagtgtggcaccctccagccttgtatcactcctccactctctagctccttcatgccagcttctccactgatcttcgccatcccccaagaacacgtttctatttcttatttaatctccagtgaatgactcccctcaagcctgcatcccactcaactattgtcctcattctcagcaggtaaagtaatttccctacctgaatgagatcaagggtgtcagactgaattcacactgccgtcctctgccaccccagtctatgactttgagttcacattctttactgcttgaactcttagttcttaacttgtccaagactgaggaatcggcatttgatcctctacattctctagaaagttacaacttttccacctccctgtcaccgtctcttccatcacatcggcaatgtctggactttttgttggcgggggaggttgtttttactgtctttcccaatggtctaattctctttttcactgtcaaacttcccaagtgcgcgcaagtctgactctcatgcctcttgacgtgattcctcctcctttaacctcttaggaagcttccatcctgatgattgtcctgaaacagatgtaaatgtcaccaaagtccccttgaaatctcagtctagtgatttccctcacaacacttattcttcttggcttctgtgttgcatttgagaaattgatctctctgatgaaacaccttgctgcatcagataatagagtcttgcttgccccaactctgtgctgttccttgttcatttctgtcacctttatctctaacatccctttttagaagtattgcctgaggctcaacccttgaatgcttgtattttctaatccatgctttttttttttttccaacaaattgtttgtttttaagaatcttggtaaatattccacgtttaccagaaaggaatgtttactctgcagttgttgggtgtaatgttctatatatatcaagaagtttaaccatgtagttcaaatcttctatatccttatttacttttttgtctccttattctatcaataaatgagagaagtg

SEQ ID NO: 174 - DNA, 8666 bp, artificial
  ss1406 sequence
tgccctcgaattccagaccctgttccctataggtaaaagatcatactttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcatacgataaaaagaggagaagtcaatcacctaaccgaccccagtaagatcgggtgtgccacaaaatgttgaaaatcctgataaatatatcttggtgacaatatgtctcccccacccagagacaggcacaaacatgtaactccagaacaacttaaaattaattggtccacaaagcgcgggctgtcgaagttttgaattgactggtttgcgatattttaaaatgattagtttgtaaaagcgcgggctttgttgtggaccccataaaagctgtcccgactccacactaagggccgcagtcctctacccctgcgtggcgtacgactgtgggccccagcgcgctcggaataaaaatcctcttgctgtttgcatcaagaccgcttctcgtgagtgatttgggatgtcgcctcttccgagtcaggacgagagggattttcattcgactggcctttcattttggtgcgttggccgagaaacccgcgactacccctcacacccgagaactgacttggaggtaaagggatcccctttggaacatgtgagtgtgtgtgtcggctggcgtctctgttctgagtgtctgttttcggtgatgcgcgctttcggttttcagctgtcctctcagaccgtaaggactgggggactgtgatcagcagacgtgctaggaggatcacaggctgccaccctgggggacgccccgggaggtggggagagccagggacacctggtggtctccttctgtcggtcagaggaccgagttctgttgttgaagcgaaagattccccctccgcggccgtccgactcttttgcctgcttgtggaagacgcggacgggtcgcgtgtgtctggatctgttggtttctgttttgtgtgtctttgtcttgtgcgtccttgtctacagttttaatatgggacagacggtgacgacccctcttagtttgactctcgaccattggactgaagttaaatccagggctcataatttgtcagttcatgttaagaagggaccttggcagactttctgtgcctctgaatggccgacatttgatgttggatggccatcagaggggacctttaattctgagattatcctggctgttaaagcaattatttttcagactggacccggctctcatcctgatcaggagccctatatccttacgtggcaagatttggcagaggatcctccgccatgggttaaaccatggctgaataagccaagaaagccaggtccccgaattctggctcttggagagaaaaacaaacactcggctgaaaaagtcaagccctctcctcatatctaccccgagattgaggagccgccggcttggccggaaccccaatctgttcccccacccccttatccggcacagggtgctgcgaggggaccctctgcccctcctggagctccggaggtggagggacctgctgcagggactcggagctggaggggcgccaccccggagcggacagacgagatcgcgacattaccgctgcgcactacggccctcccataccggggggccaattgcagcccctccagtattggcccttttcttctgcagatctctataattggaaaactaaccatccccctttttcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggctgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaacttggctaaggtaagagaggtgatgcagggactgaatgaacctccctcggtttttcttgagaggctcatggaagccttcaggcggttcaccccttttgatcctacctcggaggcccagaaagcctcagtggccctggccttcataggacagtcagccctggatatcagaaagaagcttcagagactggaagggttacaggaggctgagttacgtgatctagtgaaggaggcagagaaagtgtattacaaaagggagacagaagaagaaagggaacaaagaaaagagagagaaagagaggaaagggaggaaagacgtaataaacggcaagagaagaatttgactaagatcttggctgcagtggttgaagggaaaagcaatagggaaagagagagagattttaggaaaattaggtcaggccctagacagtcagggaacctgggcaataggaccccactcgacaaggaccaatgtgcatattgtaaagaaaaaggacactgggcaagggactgccccaagaagggaaacaaaggactgaaggtcttagctctggaagaagataaagactagggaagacggggtttggaccccctccccgagcccagggtaactttaaaggtggaggggcaaccagttgagtttctggttgataccggagcgaaacattcagtgctactacagccattaggaaaactaaaagataaaaaatcctgggtgatgggtgccacagggcaacgacagtatccatggactacccgaagaacagttgacttgggagtgggacgggtaacccactcatttctggtcatccctgagtgcccagcacccctcttaggtagagacttactgaccaagatgggagcacaaatttcttttgaacaaggaaaaccagaagtgtctgcaaataacaaacctatcactgtgttgaccctccaattagatgacgaatatcgactatattctcccctagtaaagcctgatcaaaatatacaattctggttggaacagtttccccaagcctgggcagaaaccgcagggatgggtttggcaaagcaagttcccccacaggttattcaactgaaggccagtgctacaccagtgtcagtcagacagtaccccttgagtaaagaagctcgagaaggaattcggtcgcatgttcaaagattaatccaacagggcatcctagttcctgtccaatctccctggaatactcccctgctgccggttagaaaagcctgggaccaatgactatcgaccagtacaggacttgagagaggtcaataaacgggtgcaggatatacacccaacagtcccgaacccttataacctcttgtgtgctctcccaccccaacggagctggtatacagtattggacttaaaggatgccttcttctgcctgagactacatcccactagccaaccactttttgccttcgaatggagagatccaggtgcgggaagaaccgggcagctcacttggacccgactgccccaagggttcaaaaactccccgaccatctttgacgaagccctacacagagacctggccaacttcaggatccaacacccccaggtgaccctcctccagtacgtggatgacctgcttctggcgggagccaccaaacaggactgcttagaaggtacgaaggcactactgctggaattgtctgacctaggctacagagcctccgctaagaaggcccagatttgcaggagagaggtaacatacttggggtacagtttgcggggcgggcagcgatggctgacggaggcacggaagaaaactgtagtccagataccggccccaaccacagccaaacaagtgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtgactaaaccctttaccctttatgtggatgagcgtaagggagtagcccggggagttttaacccaaaccctaggaccatggaggagacctgttgcctacctgtcaaagaagctcgatcctgtagccagtggttggcccgtatgcctgaaggctatcgcagctgtggccatactggtcaaggacgctgacaaattgactttgggacagaatataactgtaatagccccccatgcgttggagaacatcgttcggcagcccccagaccgatggatgaccaacgtccgcatgacccactatcaaagcctgcttctcacagagagggtcacgttcgctccaccagctgctctcaaccctgccactcttctgcctgaagaggctgatgaaccagtgactcatgattgccatcaactattgattgaggagactggggtccgcaaggaccttacagacataccgctgactggagaagtgctaacctggttcactgacagaagcagctatgtggtggaaggtaagaggatggctggggcggcggtggtggacgggacccacacgatctgggccagcagcctgccggaagggacttcagcacaaaaggctgagctcatggccctcacgcaagctttgcggctggccgaagggaaatccataaacatttatacggacagcaggtatgcctttgcgactgcacacgtacacagggccatctataagcaaagggggttgcttacctcagcagggagggaaataaagaacaaagaggaaattctaagcctattagaagccttacatttgccaaaaaggctagctattatacactgtcctggacatcagaaagccaaagatcccatatccagagggaaccagatggctgaccgggttaccaagcaggcagcccagggtgttaaccttctgcctataatagaaacacccaaagccccagaacccggacgacagtacaccctagaagactggcaagagataaaaaagatagaccagttctctgagactccggagcggacctgctatacctcagatgggaaggaaatcctgccccacaaagaagggttagaatatgtccaacagatacatcgtctaacccacctaggaactaaacacctgcagcagttggtcagaatatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccggctaaatacggaaacaaatatctattggtttttgtagacacgttttcaggatgggtagaggcttatcctactaagaaagagacttcaaccgtggtggctaagaaaatactggaggaaatttttccaagatttggaatacctaaggtaatagggtcagacaatggtccagctttcgttgcccagataagtcagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccctatgaattgctctacgggggacccccccccccgttggcagaaattgcctttgcacatagtgctgatgtgctgctttcccagcctttgttgtctaggctcaaggtgctcgagtgggtgaggcagcgagcgtggaagcagctccgggaggcctactcaggaggagacttgcaagttccacatcgcttccaagttggagattcagtctatgttagacgccaccatgcaggaaacctcgagactcggtggaagggcccttatctcgtacttttgaccacaccaacggctgtgaaagtcgaaggaatccccacctggatccatgcatcccacgttaagccggcgccacctcccgattcggggtggaaagccgaaaagactgaaaatccccttaagcttcgcctccatcgcgtggttccttactctgtcaataactcctcaagttaatggtaaacgccttgtggacagcccgaactcccataaacccttatctctcacctggttacttactgactccggtacaggtattaatattaacagcactcaagggaaggctcccttagggacctggtggcctgagttatatgtctgccttcgatcagtaatccctggtctcaatgaccaggccacaccccccgatgtactccgtgcttacgggttttatgtttgcccaggacccccaaataatgaagaatattgtggaaatcctcaggatttcttttgcaagcaatggagctgcgtaacttctaatgatgggaattggaaatggccagtctctcagcaagacagagtaagttactcttttgttaacaatcctaccagttataatcaatttaattatggccatgggagatggaaagattggcaacagcgggtacaaaaagatgtacgaaataagcaaataagctgtcattcgttagacctagattacttaaaaataagtttcactgaaaaaggaaaacaagaaaatattcaaaagtgggtaaatggtatgtcttggggaatagtgtactatggaggctctgggagaaagaaaggatctgttctgactattcgcctcagaatagaaactcagatggaacctccgattgctataggaccaaataagggtttggccgaacaaggacctccaatccaagaacagaggccatctcctaacccctctgattacaatacaacctctggatcagtccccactgagcctaacatcactattaaaacaggggcgaaactttttagcctcatccagggagcttttcaagctcttaactccaagactccagaggctacctcttcttgttggctttgcttagcttcgggcccaccttactatgagggaatggctagaggagggaaattcaatgtgacaaaggaacatagagaccaatgtacatggggatcccaaaataagcttacccttactgaggtttctggaaaaggcacctgcatagggagggttcccccatcccaccaacacctttgtaaccacactgaagcctttaatcgaacctctgagagtcaatatctggtacctggttatgacaggtggtgggcatgtaatactggattaaccccttgtgtttccacgttggttttcaaccaaactaaagacttttgtgttatggtccaaattgtcccccgggtgtactactatcccgaaaaagcagtccttgatgaatatgactatagatataattggccaaaaagagaacccatatccctgacactagctgtaatgctcggattgggagtggctgcaggcgtgggaacaggaacggctgccctaatcacaggaccacaacagctggagaaaggacttagtaacctacatcgaattgtaacggaagatctccaagccctagaaaaatctgtcagtaacctggaggaatccctaacctccttatctgaagtggttctacagaacagaagggggttagatctgttatttctaaaagaaggagggttatgtgtagccttaaaagaggaatgctgcttttatgtggatcattcaggagctatcagggactccatgagcaagctcagagaaaggttagaaaaacgtcacaaagaaaaagaggctggccaaggatggtttgagggatggttcaacaagtccccatgggtgaccaccctgctttctgctctaacaggacccctagtaatactgctcctgttgcttacagttgggccttgcttaattaatcggtttgttgcctttgttagagaacaagtgagtgcagttcggatcatggtacttagacagcagtaccaaggccttccaagctaaggagaaactgacctttagccttcctagttctaagattagaactattaacaagagaagaagtggggaatgaaaggatgaaaatgcaacctgactctcccagaacccaggaagttaataagaagctctaaatgccctcgaattccagaccctgttccctataggtaaaagatcatactttttgctattttagggcttgctttctgctctgtacaaaactttgtggaaggggaaaaacaggcccctgagtatgtgcctctatgcttgaaacttcttgaaactgctcctaactgcttgtttggcttctgtaaacctgcttgcatacgataaaaagaggagaagtcaatcgcctaaccgaccccagtaagatcgggtgtgccacaaaatgttgaaaatcctgataaatatatcttggtgacaatatgtctccccacccagagacaggcacaaacatgtaactccagaacaacttaaaattaattggtccacaaagcgcgggctgtcgaagttttgaattgactggtttgcgatattttaaaatgattagtttgtaaaagcgcgggctttgttgtgaacccca

SEQ ID NO: 175 - DNA, 8556 bp, artificial
  ss1410 sequence
tgcggacctccggagctattttaaattgattggtccacggagcgcgggctttcgctattttaaattgattggtccacggagcgcgggctttcgctattttaaattgattggtccacggagcgcgggctttcgctattttaaattgattggtccacggagcgcgggctttcgctattttaaattgattggtccacggagcgcgggctttcgctattttaaattgattggtccacggatctcaatattttaaaatgattggtttgcgacgcacagactttgttgtaaaccccataaaagctgtcccgattccgcactcggggccgcagtcctctacccctgcgtggtgtatgactgtgagccccagcgcgcttggaataaaaatcctcttgctgtttgcatcaagaccgcttctcgtgagtgatttggggtgtcgcctcttccgagcccggacgagggggattgtacatttactggcctttcatttggtgcgttggccgggaagttctgcgaccaccccttacacccgagaaccgacttggaggtaaagggatcccctttggaacgtgtgtgtgcgtgtgtcggccggcgtttctgttctgagtgactgttttcggtgctgcgcgctttcggtttgcagctgtcctctcagaccgtaaggactggaggactgtgatcagcagacgtgctaggaggatcacaggctgccgccctgggggacgccccgggaggtggggagagccagggacgcctggtggtctcctactgtcggtcagaggaccgagttctgttgttgaagtgaaagctttccccctccgcggccgtccgactcttttgcctgcttgtggaagacgcggacgggtcgcgtgtgtctggatctgttggtttctgtttcgtgtgtctttgtcttgtgcgtccttgtctacagttttaatatgggacagacggtgacgaccccccttagtttgactctcgaccattggactgaagttaaatccagggctcataatttgtcagttcaggttaagaagggaccttggcagactttctgtgcctctgaatggccaacattcgatgttggatggccatcagaggggacctttaattctgaaattattctggctgttaaaacaattatttttcagactggacccggctctcatcctgatcaggagccctatatccttacgtggcaaaatttgacagaagatcctccgccataggtttaaccatggctaaataaaccaagaaagccaggtccccgaatcctggctcttggagagaaaaacaagcactcggccaaaaaagtcgaaccctctcctcgtatctaccctgagatcgaggagccgccgacttggccggaaccccaacctgttcccccacccccttatccagcacagggtgctgcgaggggaccctctgcccctactggagctccggtggcggagggacctgctgccgggactcgaagccggaggggcgccaccccggagcggacagacgagatcgcgacattaccgctgcgcacctatggccctcccatgccaggaggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaactgaggagcgagagagaattctgttagaggctagaaaaaatgttcctggggccgacgggcgacccacgcagttgcaaaatgagattgacatgggatttcccttgactcgccccagttgggactacaacacggccgaaggtagggagagcttgaaaatctatcgccaggctctggtggcgggtctccgaggcgcctcaagacggcccactaatttggctaaggtaagagaaatgatgcagggaccgaacgacctccctcggtatttcttgagaggctcatggaagccttcaggcggtacaccccttttgatcctacctcggaggcccagaaagcctcagtggccctggccttcatagggcagtcggctctggatatcagaaagaaacttcagagactggaagggttacaggaggctgagttacgtgatctagtgaaagaagcagagaaggtgtattacagaagtgagacagaagaggagaaggaacagaggaaagaaaaggagagagaagaaagggaggaaagacgtgatagacggcaagagaagaatttgactaagatcttggccgcagtggttgaagggaagagcagcagggagagagagagagattttaggaaaattaggtcaggccctagacagtcagggaacctgggcaataggaccccactcgacaaggaccagtgtgcgtattgtaaagaaaaaggacactgggcaaggaactgccccaagaagggaaacaaaggaccgaaggtcctagctctggaagaagataaagattaggggagacggggttcggaccccctccccgagcccagggtaactttaaaggtggaggggcaaccagttgagttcctggttgatactggagcagagcattcagtgctgctacaaccattaggaaaactaaaagaaaaaaaatcctgggtgatgggtgccacagggcaacggcagtatccatggactacccgaagaaccgttgacttgggagtgggacgggtaacccactcatttctggtcatccctgagtgcccagtaccccttctaggtagggacttactgaccaagatgggagctcaaatttcttttgaacaaggaagaccagaagtgtctgcgaataacaaacccatcactgtgttgaccctccaattagatgatgaatatagactatattctccccaagtaaagcctgatcaagatatacagtcctggttggagcagtttccccaagcctgggcagaaaccgcagggatgggtttggcaaagcaagttcccccacaggttattcagctgaaggccagtgctacaccagtatcagtcagacagtaccccttgagtagagaggctcgagaaggaatttggccgcatgttcaaagattaatccaacagggcatcctagttcctgtccaatccccttggaatactcccctgctaccggttaggaagcctgggaccaatgattatcgaccagtacaggacttgagagaggtcaataaaggggtgcaggacatacacccaacggtcccgaccccttataacctctgagcgccctcccgcctgacgggaactggtacacagtatggacttaaaagatgccttcttctgcctgagattacaccccactagccaaccactttttgccttcgaatggagagatccaggtacgggaagaactgggcagctcacctggacccgactgccccaagggttcaagaactccccgaccatctttgatgaagccctacacagagacctggccaacttcaggatccagcaccctcaggtgaccctcctccagtacgtggatgacctgcttctggcgggagccaccaaacaggactgcttagaaggtacgaaggcactactgctggaattgtctgacctaggctacagagcctccgctaagaaggcccagatttgcaggagagaggtaacatacttggggtacagtttgcgggatgggcagcgatggctgacggaggcacggaagaaaactgtagtccagataccggccccaaccacagccaaacaagtgagagagtttttggggacagccggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgatgtaactaaaccttttaccctttatgtggatgagcgtaagggagtagcccggggagttttaacccaaaccctaggaccatggagaagacctgttgcctacctgtcaaagaagctcgatcctatagccagtggttggcccgtatgcctgaaggctatcgcagctgtggccatactggtcaaggacgctgacaaattgactttgggacagaatataactataatagccccccatgcgttggaaaacatcgtccggcagcccccagaccgatggatgaccaatgctcgcatgacccactatcaaagcctgcttctcacagagaggatcatgtttgctccaccagccgctctcaaccctgccactcttctgcctgaagagactgatgaaccagtgactcatgattgccatcaactgttgatcgaggagactggggtccgcaaggaccttatagacataccgctgactggagaagtgctgacctggttcactgatgggagcagctatgtagtggaaggtaagaggatggctggggcggcagtggtggacggaacccgcacgatctgggccagcagcctgccggaagggacttcagcgcaaaaggctgagctcatggccctcacgcaagctttgcggctggccgaagggaaatccataaacatttctacggacagcaggtatgcctttgcgactgcacacgtacacggggccatctataagcaaagggggttgcttacctcagcagggagggaaataaagaacaaagaggaaattctaagcctattagaagccttacatttgcctaaaaggctagctattatacactgtcctggacatcagaaagctaaagatctcatatccagagggaaccagatggctgaccgggttgccaagcaggcagcccagggtgttaaccttctgcctataatagaaacgcccaaagccccagaacccagacgacagtacaccctagaagactggcaagagataaaaaagatagaccagttctctgagactccggaagggacctgctatacctcggatgggaaggaaatcctgccccacaaagaagggttagaatatgtccaacagatacatcgtctaacccacctaggaactaaacacctgcagcagttggtcagaacatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccagctaaatacggaaacaaatatctattggtttttgtggacaccttttcaggatgggtagaggcttatcctactaagaaagagacttcaaccgtggtggctaagaaaatattggaggaaatttttccaagatttggaatacctaaggtaatagggtcagacaatggtccagcttttgttgcccaggtaagtcagggactggccaagacattggggattgattggaaattacattgtgcatacagaccccgaagctcaggacaggtagagaggatgaatagaaccattaaagagaccctcaccaaattgaccacagagactggcattaatgattggatagctctcctgccctttgtgctttttagggttaggaacacccctggacagtttgggctgactccctatgaattgctctatgggggaccccccccccccccccgttggcagaaattgcctctgtacatagtgctgatgtgctgctttcccagcctttgttctctaggctcaaggcgctcgagtgggtgaggcagcgagcgtggaagcagctccgggaggcctactcaggaggagacttgcaagttccacatcgcttccaagttggagattcagtctatgttagacgccactgtgcaggaaacctcgagactcggtggaagggcccttatctcgtacttttgaccacaccaacagctgtaaaagttgaaggaatctccacctggatccatgcatcccacgttaagccggcgccacctcccgattcggggtggagagccgaaaaaactgaaaatccccttaagcttcgcctccatcgcttggttccttactctgtcaataactcctcaagttaatggtaaacgccttgcggacagcccgaacttccataaacccttatctctcacctggttacttactgactccagtacaggtattactattaacagcactcaaggggaggctcccttagggacctggtggcctgagttatatgtctgccttcgatcggtaatccctggtctcaacgaccaggccacaccccctgatgtactccgtgcttacgggtttaatgtttgcccaggacccccaaataatgaagaatattgtggaaatcctcaggatttcttttgcaagcaagggagctgcgtaacttctaatgatgggaattggaaatggccagtctctcagcaagacagagtaagttactcttttgttaacagtcctaccagttataatcaatttaattatggccatgggagatggaaagattggcaacagcgggtacaaaaagatgtacgaaataagcaaataagctgtaattcgttagatctagattacttaaaaataagttttactgaaaaaggaaaacaagaaaatattcaaaagtgggtaaatggtatgtcttggggaataatgtactatggaggcactgggagaaggaaaggatctgttctgactattcgcctcagaatagaaactcagatggaacctccggttgctataggaccaaataagggtttggctgaacaaggacctccaatccaagaacagaggccatctcctaacccctctgtttacaatacaacctctggattagtcccccctgagcctaacttcactattaaaacaggggcgaaactttttagcctcatccagggagcttttcaagctcttaactccacgactccagaggctacctcttcttgttggctttgcttagctttgggcccaccttactatgagggaatggctagaggagggaaattcaatgtgacaaaggaacatagagaccaatgtacatggggatcccaaaataagcttacccttactgaggtttctggaaaaggcacctgcatagggagggttcccccatcccaccaacacctttgtaaccacactgaagcctttaatcgaacctctgagagtcagtacctggtacctggttatgacaggtggtgggcatgtaatactggattaaccccttgtgtttccaccctggttttcaaccaaactaaagacttttgtgttatggtccaaattgtcccccgggtgtactactatcccgaaaaagcagtccttgatgaatatgactatagatataatcggccaaaaagagaacccatatccctgacactagctgtaatgctcggattgggagtggctgcaggcgtggaaacaggaacggctgccctaatcacaggaccacaacagctggagaaaggacttagtgacctacatcgaattgtaacggaagatctccaagccctagaaaaatctgtcagtaacctagaggaatccctaacctccttatctgaagtggttctacagaacagaagagggttagatctgttatttctaaaagaaggtgggttatgtgtagccttaaaagaagaatgttgcttctatgtagatcactcaggagccatcagagactccatgagcaagcttagagaaaggttagagaggcgtcgaagggaaagagaggctgaccaggggtggtttgaaggatggctcaacaggtctccttggatgaccaccctgctttctgctctgacgggacccctagtagtcctgctcctgttacttacaattgggccttgcttaattaataggtttgttgcctttgttagagaacgagtgagtgcagtccagatcatggtacttaggcaacagtaccaaggccttctgagccaaggagaaattgacctctagccttcccagttctaagattagaactattaaccagagaagaagtggggaatgaaaggatgaaaatgcaacctaaccctcccagaacccaggaagttaataaaaagctctaaatgccccagaattccagaccctgctcgctgccagtaaataggtagaaggtcacacttcctattgttctagggcctgctatcctggcctaagtaagataacagggaatgagttgactaattgcttatctggattctgtaaaactgactagcaccatagaagaattgattacacatagaaagccctagtgacctatcttaaatctctgcccagaagcctacgcagatgcggacctccggagctattttaaattgattggtccacggagcgcgggctttcgctattttaaattgattggtccatggagcgcgggctttcgctattttaaattgattggtccacggagcgcgggctttcgctattttaaattgattggtccacggagcgcgggctttcgctattttaaattgattggtccacggagcgcgggctttcgctattttaaattgattggtccacggatctcaatattttaaaatgattggtttgtgacgca

SEQ ID NO: 176 - DNA, 13890 bp, artificial
  ss1411 sequence
tttatggagttctgaaaggatgaaaatgcaacctaaccctcccagaacccaggaagttaataaaaagctctaaatgccccgaattccagaccctgctcgctgccagtaaataggtagtgaaaggataaaaatacaacctaagctaatgagaagcttaaaattgttctgaattccagagtttgttccttataggtaaaaggttaggttttttgctgttttaaaatatgcggaagtaaaataggccctgagtacgtgtctctaggcatgaaacttcttgaaactatttgagataacaagaaaagggagtttctaactgcttgtttagcttctgtaaaactgcttgcaaagataaaaggagaggaggttaatctctaaagcaacctcaaattggttgcgccataaagatgttgaaatgttgatacacatatcttggtgacaacatgtctcccccaccccgaaacatgcgcaaatgtgtaactccaaaacaatttaaattaattggtccacgaagcgcgggctttgttgtgaaccccataaaagctgtcccgactccacactcggggccgcagtcctctacccctgcgtggtgtatgactgtgggccccagcgcgcttggaataaaaatcctcttgctgtttgcatcaagaccgcttctcgtgagtgattaaggggagtcgcctcttccgagcctggaggttctttttgctggtcttacatctttgggggctcgtccgggatctgtcgcggccacccctaacacccgagaaccaacttggaggtaaaaaggatcctctttttaacgtgtatgcatgtaccggccggcgtctctgttctgagtgtctgttttcagtggtgcgcgctttaggtttgcagctgtcctctcaggccgtaagggctgggggactgtgatcagcagacgtgctaggaggatcacaggctgctgccctgggggacgccccgggaggtgaggagagccagggacgcctggtggtctcctactgtcggtcagaggaccgaattctgttgttgaagcgaaagcttccccttccgcgaccgtctgactcttttgcctgcttgtgaaagacgtggacgggtcacgtgtgtctggatctgttggtttctgttttgtgtcttgtgtgtccttgtctacagttttaatatgggacagacggtgacgaccccccttagtttgactctcgaccattggactgaagttaaatccagggctcataatttgtcagttcaggttaagaagggaccttggcagactttctgtgcctctgaatggccaacattcgatgttagatggccatcagaggggacctttaattctgagattatcctggctgttaaagcaattatttttcagactggacccggctctcatcctgatcaggagccctatatccttacgtggcaagatttggcagaggatcctccgccatgggttaaaccatggctgaataagccaagaaagccaggtccccgaattctggctcttggagagaaaaacaaacactcggctgaaaaagtcaagctctctcctcatatctaccccgagattgaggagccgccggcttggccggaaccccaatctgttcccccaaccccttatccggcacggggtgctgcgaggggaccctctgcccctcctggagctccggcggtggagggacctgctgcagggactcggagccggaggggcgccaccccggagcggacagacgagatcgcgacattaccgctgcgcacgtacggccctcccataccggggggccaattgcagcccctccagtattggcccttttcttctgcagatctctataattagaaaactaaccatccccctttctcggaggatcccgaacgcctcacggcgttagtggagtcccttatgttctctcaccagcctacttgggatgattgtcagcagctgctgcagacactcttcacaaccgaggagcgagagagaattctgttagaggctagaaaaaatgttcctggggccgacgggcgacccacgcagttgcaaaatgagattgacatgggatttcccttgactcgccccggatgggactacaacacggccgaaggtagggagagcttgaaaatctatcgccaggctctggtggcgggtctccgaggcgcctcaagacggcccactaatttggctaaggtaagagaaatgatgcagggactgaatgaacccccctctgtttttcttgagaggctcttggaagccttcaggcggtacaccccttttgatcccacctcagaggcctaaaaagcctcagtggctttggcctttataggacagtcagccttggatattaaaaagaagcttcagagactggaagggttacaggaggctgagttacgtgatctagtgaaggaggcagagaaagtgtattacaaaagggagacagaagaggaaagggaacaaagaaaagagagagaaagagaaaaaagggaagaaagacgtaataaacgacaagaaaagaatttgactaagatcttggctgcagtggttgaaagaaaaaacaataaaaaaagagagagagattttagaaaaattaggtcaggccctagacagtcagggaacctgggcaataggaccccactcaacaaggaccaatgtgcatattgtaaagaaaaaagacactgggcaagggactgccccaagaagggaaacaaaggactgaaggtcttagctctggaagaagataaagactagggaagacggggttcggaccccctccccgagcccagggtaactttaaaggtggaggggcaaccagttgagtttctggttaataccggagcgaaacattcagtgctactacagccattaggaaaactaaaagataaaaaatcctgggtgatgggtgccacagggcaacggcagtatccatggactacccgaagaacagttgacttgggagtgggacgggtaacccactcgtttctggtcatacctgagtgctcagcacccctcttaggtagagacttattgaccaaaatgggagcgcaaatttcttttgaacaagaaaaaccagaagtgtctgcaaataccagtggttggcccatatgcctgaaggctatcacagctgtggccatgctggtcaaggacgctgacaaattgactttgggacagaatataacggtaatagccccccatacattggagaacatcgttcgacaacccccagaccgatggatgaccaacgcccgcatgacccactatcaaagcctgcttctcacagagagggtcacgttcgctccaccagccgctctcaaccctgccactcttctgcctgaagagactgatgaaccagtgactcatgattgccatcaattattgattgaggagactggggtccgcaaggaccttatagacataccgctgactggagaagtgctaacctggttcactgacggaagcagctatgtggtggaaggtaagaggatggctggggcggcggtggtggacgggaccgcacaatctgggccagcagcctgccggaagggacttcagcgcaaaaggctgagctcatggccctcacgcaagctttgcggctggccgaagggaaatccataaacatttatacggacagcaggtatgcctttgcgactgcacacgtacatggggccatctataaacaaagggggttgcttacctcagcagggagggaaataaagaacaaagaggaaattctaagcctattagaagccgtacatttaccaaaaaggctagctattatacactgtcctggacatcagaaagctaaagatctcatatccagagggaaccagatggctgaccgggttgccaagcaggcagcccagggtgttaaccttctgcctataatagaaacgcccaaagccccagaacccagacgacagtacaccctagaagactggcaagagataaaaaagatagaccagttctctgagactccggaagggacctgctatacctcagatgggaaggaaatcctgccccacaaagaagggttagaatatgtccaacagatacatcgtctaacccacctaggaactaaacacctgcagcagttggtcagaacatccccttatcatgttctgaggctaccaggagtggctgactcggtggtcaaacactgtgtgccctgccagctggttaatgctaatccttccaaagtacctccagggaagagactaaggggaagccacccaggcgctcactgggaagtggacttcactgaggtaaagccggctaaatacagaaacaaatacctattagtttttgtagacaccttttcaggatgggtaaaggcttatcctactaaaaaagagacttcaaccgtggtggctaaaaaaatactggaaaaaatttttccaagatttgaaatacctaaggtaatagggtcagacaatggtccagcttttgttgcccaggtaagtcagggactggccaagatattggggattgattaaaaactgcattgtgcatacagaccccgaagctcaggacaggtagagaggataaatagaaccattaaagagacccttactaaattgaccgcggagactggcattaatgattggatagctctcctgccctttgtgctgtttagggttaggaacacccctggacaatatgggttgaccccctatgaattgctctacgggggaccccccccattgataaaagttgcttctgtacatagtgctgatacgctgctttcccagcctttgttctccaggctcaaggcacttgagtgggtgagacaacgaacatggagacaactccgggaggcctactcaggaaaaggagacttgcagatcccacatcgtttccaagtgggagattcagtctacgttagactaagtacagtccagatcatggtacttagacaacagtaccaaagcccgtctagcagggaagctggccgctagctctaccagttctaagattagaactattgacaagagaagaagtggggaatgaaaggataaaaatacaacctaagctaatgagaagcttaaaattgttctgaattccagagtttgttccttataggtaaaaggttaggttttttgctgttttaaaatatgcggaagtaaaataggccctgagtacgtgtctctaggcatgaaacttcttgaaactatttgagataacaagaaaagggagtttctaactgcttgtttagcttctgtaaaactgcttgcaaagataaaaggagaggaggttaatctctaaagcaacctcaaattggttgcgccataaagatgttgaaatgttgatacacatatcttggtgacaacatgtctcccccaccccgaaacatgcgcaaatgtgtaactccaaaacaatttaaattaattggtccacgaagcgcgggctttgttgtgaaccccataaaagctgtcccgactccacactcggggccgcagtcctctacccctgcgtggtgtatgactgtgggccccagcgcgcttggaataaaaatcctcttgctgtttgcatcaagaccgcttctcatgagtgattaaggggagtcgcctcttccgagcctggaggttctttttgctggtcttacagtagaaggtcacacttcctattgttctagggcctgctatcctggcctaagtaagataacagggaatgagttgactaattgcttatctggattctgtaaaactgactagcaccatagaagaattgattacacatagaaagccctagtgacctatcttaaatctctgcccagaagcctacgcagatgcggacctccggagctattttaaattgattggtccacggagcgcgggctttcgctattttaaattgattggtccacggagcgcgggctttcgctattttaaattgattggtccacggagcgcgggctttcgctattttaaattgattggtccacggagcgcgggctttcgctattttaaattgattggtccacggagcgcgggctttcgctattttaaattgattggtccacggatctcaatattttaaaatgattggtttgcgacgcacagactttgttgtaaaccccataaaagctgtcccgattccgcactcggggccgcagtcctctacccctgcgtggtgtatgactgtgagccccagcgcgcttggaataaaaatcctcttgctgtttgcatcaagaccgcttctcgtgagtgatttggggtgtcgcctcttccgagcccggacgagggggattgtacatttactggcctttcatttggtgcgttggccgggaagttctgcgaccaccccttacacccgagaaccgacttggaggtaaagggatcccctttggaacgtgtgtgtgcgtgtgtcggccggcgtttctgttctgagtgactgttttcggtgctgcgcgctttcggtttgcagctgtcctctcagaccgtaaggactggaggactgtgatcagcagacgtgctaggaggatcacaggctgccgccctgggggacgccccgggaggtggggagagccagggacgcctggtggtctcctactgtcggtcagaggaccgagttctgttgttgaagtgaaagctttccccctccgcggccgtccgactcttttgcctgcttgtggaagacgcggacgggtcgcgtgtgtctggatctgttggtttctgtttcgtgtgtctttgtcttgtgcgtccttgtctacagttttaatatgggacagacggtgacgaccccccttagtttgactctcgaccattggactgaagttaaatccagggctcataatttgtcagttcaggttaagaagggaccttggcagactttctgtgcctctgaatggccaacattcgatgttggatggccatcagaggggacctttaattctgaaattattctggctgttaaaacaattatttttcagactggacccggctctcatcctgatcaggagccctatatccttacgtggcaaaatttgacagaagatcctccgccataggtttaaccatggctaaataaaccaagaaagccaggtccccgaatcctggctcttggagagaaaaacaagcactcggccaaaaaagtcgaaccctctcctcgtatctaccctgagatcgaggagccgccgacttggccggaaccccaacctgttcccccacccccttatccagcacagggtgctgcgaggggaccctctgcccctactggagctccggtggcggagggacctgctgccgggactcgaagccggaggggcgccaccccggagcggacagacgagatcgcgacattaccgctgcgcacctatggccctcccatgccaggaggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaactgaggagcgagagagaattctgttagaggctagaaaaaatgttcctggggccgacgggcgacccacgcagttgcaaaatgagattgacatgggatttcccttgactcgccccagttgggactacaacacggccgaaggtagggagagcttgaaaatctatcgccaggctctggtggcgggtctccgaggcgcctcaagacggcccactaatttggctaaggtaagagaaatgatgcagggaccgaacgacctccctcggtatttcttgagaggctcatggaagccttcaggcggtacaccccttttgatcctacctcggaggcccagaaagcctcagtggccctggccttcatagggcagtcggctctggatatcagaaagaaacttcagagactggaagggttacaggaggctgagttacgtgatctagtgaaagaagcagagaaggtgtattacagaagtgagacagaagaggagaaggaacagaggaaagaaaaggagagagaagaaagggaggaaagacgtgatagacggcaagagaagaatttgactaagatcttggccgcagtggttgaagggaagagcagcagggagagagagagagattttaggaaaattaggtcaggccctagacagtcagggaacctgggcaataggaccccactcgacaaggaccagtgtgcgtattgtaaagaaaaaggacactgggcaaggaactgccccaagaagggaaacaaaggaccgaaggtcctagctctggaagaagataaagattaggggagacggggttcggaccccctccccgagcccagggtaactttaaaggtggaggggcaaccagttgagttcctggttgatactggagcagagcattcagtgctgctacaaccattaggaaaactaaaagaaaaaaaatcctgggtgatgggtgccacagggcaacggcagtatccatggactacccgaagaaccgttgacttgggagtgggacgggtaacccactcatttctggtcatccctgagtgcccagtaccccttctaggtagggacttactgaccaagatgggagctcaaatttcttttgaacaaggaagaccagaagtgtctgcgaataacaaacccatcactgtgttgaccctccaattagatgatgaatatagactatattctccccaagtaaagcctgatcaagatatacagtcctggttggagcagtttccccaagcctgggcagaaaccgcagggatgggtttggcaaagcaagttcccccacaggttattcagctgaaggccagtgctacaccagtatcagtcagacagtaccccttgagtagagaggctcgagaaggaatttggccgcatgttcaaagattaatccaacagggcatcctagttcctgtccaatccccttggaatactcccctgctaccggttaggaagcctgggaccaatgattatcgaccagtacaggacttgagagaggtcaataaaggggtgcaggacatacacccaacggtcccgaccccttataacctctgagcgccctcccgcctgacgggaactggtacacagtatggacttaaaagatgccttcttctgcctgagattacaccccactagccaaccactttttgccttcgaatggagagatccaggtacgggaagaactgggcagctcacctggacccgactgccccaagggttcaagaactccccgaccatctttgatgaagccctacacagagacctggccaacttcaggatccagcaccctcaggtgaccctcctccagtacgtggatgacctgcttctggcgggagccaccaaacaggactgcttagaaggtacgaaggcactactgctggaattgtctgacctaggctacagagcctccgctaagaaggcccagatttgcaggagagaggtaacatacttggggtacagtttgcgggatgggcagcgatggctgacggaggcacggaagaaaactgtagtccagataccggccccaaccacagccaaacaagtgagagagtttttggggacagccggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgatgtaactaaaccttttaccctttatgtggatgagcgtaagggagtagcccggggagttttaacccaaaccctaggaccatggagaagacctgttgcctacctgtcaaagaagctcgatcctatagccagtggttggcccgtatgcctgaaggctatcgcagctgtggccatactggtcaaggacgctgacaaattgactttgggacagaatataactataatagccccccatgcgttggaaaacatcgtccggcagcccccagaccgatggatgaccaatgctcgcatgacccactatcaaagcctgcttctcacagagaggatcatgtttgctccaccagccgctctcaaccctgccactcttctgcctgaagagactgatgaaccagtgactcatgattgccatcaactgttgatcgaggagactggggtccgcaaggaccttatagacataccgctgactggagaagtgctgacctggttcactgatgggagcagctatgtagtggaaggtaagaggatggctggggcggcagtggtggacggaacccgcacgatctgggccagcagcctgccggaagggacttcagcgcaaaaggctgagctcatggccctcacgcaagctttgcggctggccgaagggaaatccataaacatttctacggacagcaggtatgcctttgcgactgcacacgtacacggggccatctataagcaaagggggttgcttacctcagcagggagggaaataaagaacaaagaggaaattctaagcctattagaagccttacatttgcctaaaaggctagctattatacactgtcctggacatcagaaagctaaagatctcatatccagagggaaccagatggctgaccgggttgccaagcaggcagcccagggtgttaaccttctgcctataatagaaacgcccaaagccccagaacccagacgacagtacaccctagaagactggcaagagataaaaaagatagaccagttctctgagactccggaagggacctgctatacctcggatgggaaggaaatcctgccccacaaagaagggttagaatatgtccaacagatacatcgtctaacccacctaggaactaaacacctgcagcagttggtcagaacatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccagctaaatacggaaacaaatatctattggtttttgtggacaccttttcaggatgggtagaggcttatcctactaagaaagagacttcaaccgtggtggctaagaaaatattggaggaaatttttccaagatttggaatacctaaggtaatagggtcagacaatggtccagcttttgttgcccaggtaagtcagggactggccaagacattggggattgattggaaattacattgtgcatacagaccccgaagctcaggacaggtagagaggatgaatagaaccattaaagagaccctcaccaaattgaccacagagactggcattaatgattggatagctctcctgccctttgtgctttttagggttaggaacacccctggacagtttgggctgactccctatgaattgctctatgggggaccccccccccccccccgttggcagaaattgcctctgtacatagtgctgatgtgctgctttcccagcctttgttctctaggctcaaggcgctcgagtgggtgaggcagcgagcgtggaagcagctccgggaggcctactcaggaggagacttgcaagttccacatcgcttccaagttggagattcagtctatgttagacgccactgtgcaggaaacctcgagactcggtggaagggcccttatctcgtacttttgaccacaccaacagctgtaaaagttgaaggaatctccacctggatccatgcatcccacgttaagccggcgccacctcccgattcggggtggagagccgaaaaaactgaaaatccccttaagcttcgcctccatcgcttggttccttactctgtcaataactcctcaagttaatggtaaacgccttgcggacagcccgaacttccataaacccttatctctcacctggttacttactgactccagtacaggtattactattaacagcactcaaggggaggctcccttagggacctggtggcctgagttatatgtctgccttcgatcggtaatccctggtctcaacgaccaggccacaccccctgatgtactccgtgcttacgggtttaatgtttgcccaggacccccaaataatgaagaatattgtggaaatcctcaggatttcttttgcaagcaagggagctgcgtaacttctaatgatgggaattggaaatggccagtctctcagcaagacagagtaagttactcttttgttaacagtcctaccagttataatcaatttaattatggccatgggagatggaaagattggcaacagcgggtacaaaaagatgtacgaaataagcaaataagctgtaattcgttagatctagattacttaaaaataagttttactgaaaaaggaaaacaagaaaatattcaaaagtgggtaaatggtatgtcttggggaataatgtactatggaggcactgggagaaggaaaggatctgttctgactattcgcctcagaatagaaactcagatggaacctccggttgctataggaccaaataagggtttggctgaacaaggacctccaatccaagaacagaggccatctcctaacccctctgtttacaatacaacctctggattagtcccccctgagcctaacttcactattaaaacaggggcgaaactttttagcctcatccagggagcttttcaagctcttaactccacgactccagaggctacctcttcttgttggctttgcttagctttgggcccaccttactatgagggaatggctagaggagggaaattcaatgtgacaaaggaacatagagaccaatgtacatggggatcccaaaataagcttacccttactgaggtttctggaaaaggcacctgcatagggagggttcccccatcccaccaacacctttgtaaccacactgaagcctttaatcgaacctctgagagtcagtacctggtacctggttatgacaggtggtgggcatgtaatactggattaaccccttgtgtttccaccctggttttcaaccaaactaaagacttttgtgttatggtccaaattgtcccccgggtgtactactatcccgaaaaagcagtccttgatgaatatgactatagatataatcggccaaaaagagaacccatatccctgacactagctgtaatgctcggattgggagtggctgcaggcgtggaaacaggaacggctgccctaatcacaggaccacaacagctggagaaaggacttagtgacctacatcgaattgtaacggaagatctccaagccctagaaaaatctgtcagtaacctagaggaatccctaacctccttatctgaagtggttctacagaacagaagagggttagatctgttatttctaaaagaaggtgggttatgtgtagccttaaaagaagaatgttgcttctatgtagatcactcaggagccatcagagactccatgagcaagcttagagaaaggttagagaggcgtcgaagggaaagagaggctgaccaggggtggtttgaaggatggctcaacaggtctccttggatgaccaccctgctttctgctctgacgggacccctagtagtcctgctcctgttacttacaattgggccttgcttaattaataggtttgttgcctttgttagagaacgagtgagtgcagtccagatcatggtacttaggcaacagtaccaaggccttctgagccaaggagaaattgacctctagccttcccagttctaagattagaactattaaccagagaagaagtggggaatgaaaggatgaaaatgcaacctaaccctcccagaacccaggaagttaataaaaagctctaaatgccccagaattccagaccctgctcgctgccagtaaataggtagaaggtcacacttcc

SEQ ID NO: 177 - DNA, 10397 bp, artificial
  ss1416 sequence
  misc_feature (2779)..(2878): n is a, c, g, or t
tgattcaacccctagcttggcaacttccatatgccacaggagtggccctacagagcaaaaaaaaaaaaaaaaaaaaaaaaaaagtggtacatatatacaatggagtactactcagccataaaaaagaatgaaaaatgacatttgcaacaacatggatgcaactagagattctcatagtaagtcagagagagaaagccaaatatcgtatgatatcacttacacttacatttcactttagatgtgaaatctaaaatatggcaaaaatgaacctatccacaaaacaaaaagagactcacggacacacagaatagacttgtggttgccaaaagcaaaggatgaggtatcataaaaagcttcacaaacattatggagctaaattttcttatgtgttaaagaaatatccatttactaccagacctttttatttttaccccgatttgaaatatagcttctagaacaaaagaaaactgacttcaggttctgttaggaattcagctctgttgaatagtcttcctaagaaagacgtaatatttttcatttttatttagaataaactcaataccttgaccacagatgaattatgacctctaacagtcactcacagtgtgtggtcctgcaagatccatcctctagtattccctcaattggcttctgcctttgtttgttttgttttgttttgttttagtaagcccagcccatcatcccattcagcctgattcccactgctggctgaattctgcaatcagttctttttttattttataacgatttttattgtttcctttatagctggtttatagtgttctatcaattttctaccatacagcaaagtgacccagttacacattcatgtatacattcttttttctcacattatcatgctccatcataagtgactagatatagttccctgtgctatacaggaggatctcattgcttatccattccaaaggcaattgtttgcatctattaacctcaaactcccaatccattccactcccttcccctctccctcccccttggcaaccacaagtctgttttccatgtccatgattttattttctgtggttcatttgtggtgtatattagattccagatataaatgatatcatatggtatttgtctttctctttctgacttacttcacttagtatgagcgtctctagtgccatccatgttgctgcaaatggcattattttgttcttttttatggctgagtagtatttcattgtgtatgtatactacatcttcttaattaaatcatctgttgatggacatttagtttgtttccatgtcttggctattgtgaatattgctgcaatgaacatgcgggtgcatgtatcttttttaaggaaagttttgcctgggtatacgcccaggagtgggattgctgagtcatatggtagttctatatttagttttctgaggtatttccatactgttttccatagtggttgtaccaatttacatgcaatcagttcctaacacacaatgaaattttcattagctgaggcactgcagttgaatggatatggttgtgtatccaagaagcagacaagatgacctaatcacacttttccatttctacctccagtgataccatgaatacaatgcagccagcagcatgctcatcactgtaaaagagctaaacttttatatcttaaaaataatcagtactcattagaagcagagtagtgtaaattaatgaccctatcactggaagttagaacatgattgttttattcctagctttattactgattttactacaagaccttaactgacatgctgcatttttctcagctttattttctgtagctggagaatctgagcctgctttcattctgtagcctctgattattggttctattagagatgaatgacagtatagataagcaaaagtcattttcatctggcttgagaattattaataatttatgtttgtgaaactgacttttggggaagtcacagttttttgtttttgttctgtttttttttttgctttttagggtcgaacccacgacatatggaggttcccaggctagaggtccaattggagctacagctgctggcctatgccacagccacagcaatgcaggatccaagctgcatctgcaacctacaccatagctcacggcaatgccagatccttaacccactgaatgaggctagggatggaacccacaatctcatggttcctagtaggattcgtttctgctgcaccacgacaggaactccagggaagtcacagttcttgaaatcagaaaataaagcgacactataaaaactgacttaggaaaaattggaaattttaatgtatatattaaattaattatattaattaaataattaacatataaattaatatattaaatttatttatatatatacatagtatctcattacccttccttccttccttctttcactacccaaagaaaaactgtccttcctcaaagttcttatcatggctcagtgtaaacgaatctcaccagcattcattaggaagcaggttccagtgggtggctcagtgggttaaggatccagtgttgacatgagctgtgatgtagatctcagatgcaatttggatcctgcattgctgtggctgtggtgtaggctggcagctacagctccaatttgacccctagcctgggaacctccatatgtctcaggtgaggccttaaaaagataaacaaacaaacaaaacttaacttctgtccttcctctttctttccaaacaagtgttctagacctcaccttgtctagaggacagcaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacaaaagtctaaggtcagaaaaatccatgcacactgatttcagtggcttcctgtcttgagcagtcttcaggtaagcagccggaatgactttccacgactacctggtcccaggctttcagccagtaatccctgaaaaattggaaaagacacatagccatatggccacatgccgtgtgccctgtggccttccttgccttgaacctctcttgatggggtaatctatcaaatggttaatggcttggcagttagggaatactcttcacagtgtcctctggtcatcactaacctcaaaaaaagtttttaatttgatgttattggggctagcaggtattttttttttttcagtaacagtgtactttatgctgtgtctttacttgcccatcttaattcataaaggtttgtcagcattaatacttatcagggaatatcaaaagccatgcccttcctaacttaagaagtctttgctctggcttttccagaatcctgccaaaaatgattatgtcatctaaatagataaatgcctctaggttatttatatcccccccaattactttctccattaaacactgaaaactggcagaggctcttgaaatacttttgggcctcctttcaaactgatgttccgtccctatttcacacacagagcaaacgaaacagatttttctcttggtcttccttagccatgggtatttgatcattcttactctttgagtccgggtatgacttccagtgtctccctggcagatagtaccaggtggctcaaactccaggggtaggatacttgtttattttagtgtactactgctcagaatgccatagtccctggaattatacttggtcaatttctttcataccaccacgtcgaaccatacctagggctctgggacttgggtataatgctgctgatgaataattctttagtatgctcatagttgttatattttatactttataatctatgtagaatacttctggaaagtgtgtggatcatttttattctattctttgttgtctctctgaacatatttctcactcatagataaacaaaaaatgctggcatcttaaactttatgttcccagtctctcattccattctttagggaattttgaaatatcttcaaaatccaaacattctaacttctctagttagaaaacccagggttttatagcacatatctctctttggctaatatgctcattctctttttttaggtatcttcaaataaacatgaagagaaaaaaacatctaaatattaaggtctgtctctgctgacactcctggacccacccttacagaaaattggaattcgttctcataagtaatgacacactccacagacctcccagtctggtgcacataacgctagattatctacctgctaaatgttcccagagccactgagagaaattctagtctaaaattaaaaacaaacaagcaaaatataagaataattttccaaacttaagacatgtaagctcaaaaccatctacctctgcattgtgggatgtcatcaatattcccccttagggttgggtccaggtttttaggacctttgaccttatacaatttaggtgtctctttaagagaaagaataaaaattatatatgcaagatttcacacaaggatgttgaccaggaagtacaaaaatgaatattttaagatgttttctccctattcttaagcatcaaacaggaaatccctcgtcttctctggagaactttgctccttcaactatcccttctctcttccaaactcgacctttcctctctgctggatcattcagatcatttctcttatgcaaagaaatgctattatcattcatccttaaatgtgtcacttgaaatgctcattaacaatttccgggaaattaaaatagaacctaggtaataaaacaaaatctaacctttttttcccttttgtcttagcctagtttcacttcttcatagggtgccacatgcagaggccttgtactcatatttcagatgagagttcctggtgcaaaatggttatgcccaacacctcagctcagcagagtgtgtgcagagacactgcacctgccacttcaatctggagtgcaatgagatgcatctcacctgcaagaactccacctccctcctcttcccactggcaagaattctataaagtagccctgctcatggtatttcaagaaaagcatgtgctctagggcatgagctcacactactccattctttgatcaaagaatgaagatttccttcacttctgagctaaactcagtcttattttattggctagaatgacaataggcagaaggacccttgttgtgcatctagtcaggaggatctataaaaaatttttggtgaccacaatggagagaccatggccttttttcctacacctatccactagtctttaggctcactaacctccaggagtcaacagtagccctctccacagtcaccttttgtttggtcaaggaaagtggccaattcttgtgagccaagatataagaccaggaaaaggcccagtttctagcccatgactacctggcaaaaaaggatactcagtctgagttcaagaagaggcactgagagagttccccttgtggtacaacagaaatgaatctgactagtatccacaaggatgagggtttgatccttggcctcactcagtgggttgggggtccagcattgctgtgagctgtggtgtagaacacagatgtggctcagatcccacgtggctgtggctgtggcataggccagcagctgtagctccaattcaacccctagcctgggaacttctatatgccaaggttgcagccctaaaaaaaaaaaaaaaaaaaaaaaaaaaaaaaagcactgaggatgcccaaatgtaaaagggtcccaaggtggcttaacctcttctggtcagcactagtttctctgaagtaggctgaggagccctgtgagctgctcacaagaccaggaacccattactggggagccctgtgagctaaaagcaaaaacaggaaacacccaccatcaaacctctcttctttcctctgctcacgaggtgaatcttgggtgatttgttactgactgaggatccatggcctctccttctgatatcagtacaaaactctagctgtcccagagatgtggtgagtaccccatgagaatcccacatgctttaagctcttacccagcaggaagtccaaaaactcctcctttttcacagaaaggaagaaagagaaaatccctgtttcagacaactctaagttggtcaggaactaacaatagctaagctgctctggtctggagcagtcctgtctaacttcctgtgagacattctgatgaggagggactaactacaaattcaaaaggggccccacagtaatatcatggtccatgccatttatatgtcttctattttggttttttgaagaatctgttatcagtttggtgctggttccaaatttccagaaccggatatcttatttgggtcaaatcttatggtatttgcatgactaatgaccagccagggtccaatgacccgccagaaaaagtattacctttgaagcaggtcccaatggagaagaaaggttcatccaggtacaggtcccatttaccatttctgatctatgtaactagaaaagttattataaagggttgagggaagatccagaggggttcctgaatctgattagggtaatgagacccatgacaccctgcccctcaccccaaggctgacacccagagcctcctcaaagtactcctagtggggagagaaaagaccagacaaagagaacagaaacaatgcaggccattccattttcagactgaggaatcaaatggtcccagacaatgacccaactgggaccactgaaacgatggagaagagggtggaagagagaggctgactcattataaaaatatgatcctaaagggaatctaggcagcaggccagatacctgccaattggaacaaggtaaaggaaatcaatcaagagccaagagaaaaccttttggcattcctagaacatctcaaggaatgcctcccaatctactatcactgatcctgagtctttggaagagaatcctgaggtgatattttgtttcccaaagtgccccaggcattaggtgtaaacttcagaaaatggaaatagaaccagatgcccctccctgtcgcctggtcaaggttgcttactgagggttagggtgtttaataacagatataaagagaaagtcagaggataaaaaagcccagagggtttttttcctcccacatcaatcagctgacatgaaaaccaaacttaactgcccatagagactcaactctggtatgaccgccaacccccaccaaggaatagcaagccaaggaaactaggacccaataactgcaccatatgtaaatgccagggacactgaaagggagaatgccctcactgccctgaaaaggggattgaacatggcagatcctggccactaacctcaaaggcaggtccaagcagatgaagaatgatggggccagagggctcctaagctggcacaacaatgatccccaaagagacctggctgacgttggacataggaggaaagattgtctaacacttacttgacaccagtgccacttactcagttctgaacaccagatcaggcagactcagtcacaagaggtatacaattacgggagtgtcagggaaggcattcatagagccattagcatataagttggatgaatacatgctcacccattccttcccatatgtccctgaacatccttatatccctgcaaggaagagctagcttacataaatttggggctaatatccatctaatgggagacaaattggagactggcttcccctgagacaaagggcacagatgataatgttaaggactgaggaaaaacttctccagacagagcaaggttgatctctttggaataaattcccagtaaatcagggacaatgagattagctgtaggaaccaggcctgtgacagtccatctaagacccagacatacatggcccaatagaaaatagtaccctctccttcaggaggacttattgaacattgcccctgctatacagagcctaattgactagggactgattagaccatgccaatcaacctgtaatactctctttctgcctgtaaagaagcctaatggggaatgctgggtggtacaggacctcaggacagtcagaaaagccacctaggatatatcgccaatagtacctaatcttacactccgatggtcactctaccatccataaggacataatattctgtattgcatttaaaagatgccttcttttctgtattccgttagccccagaatcacaagaaatttttgcttttgagtggcaggacccaaacatgcaacaaaaatgacactgctagatagcctgccccaagggttcaaaaattcatctttggggaaacttaagctaaattttctacatctaggggaattttcacatctcttccagtgtgtagatgacattctgatcaatagccctacaaaggaggcctctgacagaaatattgtaaccaccctgaaccacctcactaataaagaatatacgatgtcccagaaagaggctcagctatcacaagctattatgatccacctaggtatcattctcacagaaggtgggagaagtctagcccaggaaaagaaagacaccatttgcagtctcgcccctcctgaaactaaaaaacaccttaggggttttctgaggttggctgtgtttgtgcatctggatccctaactaggtctaatcgatagatctttatatgaaaagttgaaagcatgatgatccttttgaatagaattcagaatacaaagaagccttttaagacttgaaaaagcaattactaactgatgtaatttgctgtatgactgaaattaatacaacttcgtatatcaactatattctaataaaattttttaaagtaaaataaaagaaagaaaaagcaattgcttcagtcccctgccctggccctgccagatttagctaaaccctttgacctttacattcatgagagaagggaaaccaaaccgcccttgggatattagttcaaaactagaaccccttactccagtggttgcttatttctctaagcaattagattgaactgctaatggatggcctccatgcttatgggcagtagtacctactacagccctactaaaggaggctgaaaagttcatgtttggtcagccagtcactatatggactccctactaggtttaggctttagtaagttccaagggaacagaatagctatcccctggaaggtggattcacatccaagctatgctttttgacaacctagtggttaccttaccataaaactctgacacatgctaaatcctgccacactgctacccacagaagtggggtccctgcagcatgattgcatagaaaccatagacatgttctattccagtttctctaacctaagaagtgagactctcaaaatgccaaagaggaattgttcacagacaggatcagttttatgagagagggaaaaatgttggcaggatacacaacggtctcctagacctaagtcagagaagcacagaacctatccccagggacttctgctcaaaagatggaaatgatggccctcacctgagccttggagctcaggacatggaagatcccagtatgtgtatgtcatcctatatgcacaagagctatttgaaaggaaagaggtatgcttactatagagaataaacaggtgaaacatggcttaagcataatgaagctcctagaagcagtgaagctttcagaaaagatggcattgattcattgttgaagtcaccagagggaaatgcagagataataaagggaaacaacaaggggggtacaattgccaaaagggcagccttagagccagtaacttggcaaatacccctcatacctgaaggcctgatgcatccaattatttcctagtctacacaaaggaagaactggacaaagcccaaaaacagggcttcagtagagatttaggaagccatggatggctggttgatgaacatgggcaatacttctttccccaaattgcagtttgtcaagccatcaggagagctcatcaaggaattcactacaggagggaagccctatataagtggtcagtttaggtcatggtaactcctggcatgaaaagtataaccagtctaatagttgagacatgccccatctgtgcaatgaacaaccgttaacaccagatctcccccaggaacccccaaataaggcccattcagacgagagggatatatcctggagaagactggcagattgatttcactctcatgctaagaataccagtatgttcaggtatctattggtgctagtagactaacattttatggttggatagaagcattccccgatagtcccaaattttgacctaaccgtgaatcactttctctcatttcccacttagctagaggggctaagtcattactaaaagaaataatccccaggtttgggatcccaggattcctgaaaacaataatggtccagcattactgtttcaagtg

SEQ ID NO: 178 - DNA, 7428 bp, artificial
  ss1426 sequence
tgtctgaaaaggtagctgtgtgccttttcagttcttctcaccttataccttccttcttgtaattatgcagcaactacatatcctatgtccaagccagcagccctgctaatcctgctccaagcatttcttatcaatttcacttctgtaaccttgcttgctcagttttttaaggcaggaacagtgtctgctcaggaaagggggaggtctgggctgcttacatggaaaagcaaggccttgtatggaatgaaatttgctgagaacaaagacctgaatctcagactctggaggtgacctccctgagcctgcaccagtgctgaaagaaccttgattttctgcatctctgagtgctatttgtctccttccattgctatgatttatgcagtctgcaacattttctggtgcatgggctgggaagccaacaactgagctagcccactgtgtcaccattgctggggaaccagggaaagccttcattgccagcccagtgacaggcagatagtgcgcacccagccactttgctggttccagaacctcactcgggccatgccagccccagctcacaccacttcctgaacagactcagaaggagagcagaaacaggttccaggacagggcatcagactggtgagtgccctggggacatctgttcaagtcaggacctgccatacaggcaaaggggaggctgatcacctctcagtgaccatagggtcactcagataggatttctttcctagggttggagtggcttatcaattctggtgtgtgtgtgtgtgtgtgtgtgtgtgtgtgtgtaaatgactgaagagaatgagagcccatgctccactgtctttggattatagagccagagtgtgtcctaaactgtagttccatggtggccctcatatggcttatggtgaccctcttttggggggccctgatgttgggggttatacagtcccaacaatgctaagagttgcctgaaatatctcctccaggggagcagtcaggtggatgaagagattgttctctgaggccttgtcctcgctgtttgtcttgcatcactgacacagggtgcaaattcatacaatgggtaaatgggcttcagagcccattctcttagaatgtatggttaagaattttaagacaggctttttctggtgattatggtgttaaactgagctctggaaaattgtaccctagagtggctctccttcggggttgtatggcccttggaagggaccttagatgtgccaacaatttgagcagtatataatgttataacaggagactctggaaatccaattgatcaatggttagaaattgctcagttgaggcttccatggattctgttctgcatcacaggccatgaacaatgtaagatactaatggtccagtccaagaaggaaaacttgtcttgagaaaaggagccacctatttttcaaggggaggccaaggactcaccccttgcgccacctccctatgttctgccagcccctcctttgtgggatgaaggtctccagttgtaaggcatggggcccaaggccagggaaaaggagcctcctgggacatgatcaatgtgcttactgcaaagagaagggacattggaaaaatgaatgccccatccatcctgagaaaaggaccaagtggcacccccacctagcagataccaatctgagctatccagtgcaaatctgattggcctagcagagtccaacttggggggaccaggctctctccagctgggtccctgagagcccatggtcagaattcaagtaggggaatgccctgtagaatttatggtaggcacaggggctgaatattcagtgggcatgcaacctgtagctcacttcttgggtagagaaactatcatcattggggccattgcaaccaaactcacagacccttctgtggtccctgccagtgccagttaggaagccatgaagtaatgcatgaatttctttacctgcatgactgcccagcctccttaatgggaagagacaagctggctaaaatgggggcacaagtttccttttccactgatggattgcccaactcaggttaacagaatccccctcttctttaatcatgactcttgtggtaagaagggaagaagaatggcactagtactcttacccttcagaaattggaacagttcccccagaactagaaactgagtacccactggtttgggccaaagggaatcctccaggactagcaaggcaccatgtccctattttgattgatctgaaacatggagctcaacaagtaaggctgtggcagtacttgattccccgagaagctcgactggtaatccaggaccacctggacaggttacttcagcacagactgttgataaagtgtcagtctccctggaatatccccttactccttatgaggaaaatactaacacaagactaccagttcaggacttgagaggcataaatgaagcaacaattacattgcacccatttacctaacctgtatactttgctatggctgatgccttccactgctgagtggttcacttgcttggacttaaaagatgccttcttctgcctctgagtggcacccaacactcagcctttgtttacctgtgaatgggaaaatccacatacagggacaaatgagtagctcacctggatgagacttacacaaggatttaaggactctcccactctggctgaatttcctggacaaaaactggactgtgttttgctgcagtacattgacaacctcttgctatctcaaggctaaatgcctagagggggcaaattctttcctctccctactaatggaggcagggtatcaggtatcaaagaaaaaaaggtacaaatctataagaaaaaggccaagtatccaggctttaacatcatgcagggctgacaaatgttgagaacttaaagcaggcagtttgtgccattccagtccctaccacctgccaggtttgtgagttcctaggggcagcagaattctgccagatatggatccctgggttttcagatttggccagacctatgtatgaggctgtaaaagggaaataaaatgctccctttgaatggggaccaatccaggaggccacatttcaggcaatcaaaatcaaactcactgaggctccagccttcagacttccagatgtaaccagagaattaacctctttgttcatgagaaaaatgggatgaatttgggagtcctaacctgagagtttgggccttggcagaggccagtgacatgtctgtctaagcaaattgactcagttgcagctggatggcctccctgcctccatgtgcagttaccaccttattagtaaaattggctgacaagttaactctgggacataacctcaacattaaagtcctgcattcagttgtaaccctgatggacactaggggctatcattggcttacacgtgcatgaatgactcaatatcaacggttactatgtgaaaatccgtgggtaaaactggaggttgtacaaactctgaacacagccacttttctaccagataaagtaggactcccagactgtaactgcttagaggtcctgggtgaggtttttttttccagcaggcctgacttaactgataggccactcaaaaacccagacctggttttatataccaatggcagcagcttcatggaggatggaaaaaggatggcaggatatgctgtgatatctgacttagaagtgatggaagcagagatgcttcctcaaggttggtcagcacagagagcagaattacaggatttaattagagcactgtaactcagccaaggccagtgaggtaatatctatactgattcacagtatgcctttccaaccctacccatccacggaggcttatataaggaaagaggacttctaactgctgcaggaaaagggattaaaaaccaagctgaagtattaaagctcctagaggtggtatgtgaacctaaagaagtgatggttattcactgtaaaggctgccaaagagggaaacccagcggcaaaagaaaactgcagtgctgatgcagccaccagactagcagcctgggggaaacaaccagataaacctaaggtctttctggtgccagaggtgccaacagtctccaagtattcttcagaagaaaatggataagggaggaattaagatgggatggtaggttacacaggaccatctagtttatgttctagtttatgttctataaactagtccacgggcagcatgagttaatgcacatggacaaaactgccttagagatcttactgggccagtactacctaattgtatgtctttctgcactctgctccactgtctcccaatggtgcacaacctgtttaccaaataatgcttgccagaggcctagcagaccagctgggatacaacattgtggactgtccccacttgaggatatggaagtggactcgctgaagtcaccctgagcagggagtacaaatacttgctagattttgtttgtaccttttcaggatgggtagaagccttccccacccaaactgaaaaatcaaggaactcttaagagacatcattcccagatatgtaatgcctctaaccattgggtcagacaatgaaccagcatttgtggctgagacagggcaccaggtggcaaaagccttacagatatggtggaagttacattctgccaatcatcctcaaatttcagggaaagcagaatgcatgaactgaacccttaggcagacactagcaaagttatgtcaggagactggcttgccctgggtagatatgttgcctgtggccctcctaaaactcagatgctcaccctgagtgggaataggattctcaccatttgaaattttatatgtgaggccacctctactgatcagcttgagaggaaacaccagagagttgggagacttggacttacataaacaattacaaggatttgggctcactatctcacaaatacataaatgggtcctggatagaatacctgtatctttaggcataacagcacaccctcacaaaccaggggacgaggtgtgaataaaggactggaaaaaagaccctttaaggccagtatggaaaggcccctgtactataattctaaccacccccactgctctcaaaatagcaagaataaatgcttggatccatcattccagagttaaactggctggcccatctgatgaccatgggggatgggaagctgcccttgatccagagaaatccctatgcctgacaagacagaggaagaggtaacaatctcaaagccctgctctgaccacactggaagctgttcagtcaatacatggctgaagcttgaggaattgactgcccagtaaaatagactgccttattttccataagagactgacttactgtcatatattattatcctatatccaacatatatatttgctgtttgttggtattaatctggtctcccttggccctgccaggatccatttcttcatgtgacccatgcattcaagtgacccaatcagatcagggggttacatgaactttgctttactccactcatttctcctgttcaggagaaatccaaggaaattgtacccacaacaaaaccacttattctatctgtcaacagggggaccaatatacatgctttgatccacaatactcaccaactgaggaatgattaggggtctagcactctcataaaacagggcatctgattaatcagacaaaaattaccaaccttgagttgcaagtatcaacactttttgatgcttgtgaagctatgaacaagtcatggacttctatcataccatgtgggagcccaccatgtgaaagcgaatacaggctctaagataaatatatgtgctgggggaccacctggagcagttgccaggactgcacttactggagcagtgtatcctgggaaacctgggataagggagacaaaacagctgggcacatcaaaagggcacagcccctccacactgtcagactaaaacttgaaacccagttaatttcactatttacaattccagtgagcccaagtggaaggagggtttcataattggcatacatattcatggaagaggccttgacccaggagctctgttacattttcagaaagtcatagagaggcttcaaactgcctctcacaagattttccattccttttatgaggagataaaaatcaccctgcctgccattgtggccacaactaaaaacttgcttttggtcctggcagaaacaattgcacaaaccctcaaggtctcctcttgttatgtacgtggggggatgaatgcaggagatcattgaccttggcaagctagggaactgaacctgttagagcctcttaatgagactgctcaccagtggggtatggctccttgaaattgacattatagtgaaaagctgccttataaggcagggaggatggttcagtgtctcagtcaggaacctaacatgtttaggcctaaggttttataacctgactgcccaaatgactcaatggtgggcatcttccaacgtctaagagcccaagcctaatcttctaacttttcccacctctgaaagcatgggacagtatcagtgctgatatcaacagtgagcaccaaagtgattatataggatttgagggaaaatggcatattctgtatccccccattgggccagggcatgcatactaggaacaattggaccatcctttttcctgcttccactgtcactaggagagtaattgagagtccctatatataggacacaaggaactcagatagacctgagggctctccagattggaagctggaaggatgatgaattgtccccagaatgaataattgaatattatgggtctgccactaggcagaagatggcttttggggatatcacacccctatctatatcctaaaacacatcattagattacaggaggcactggagcttataacaaataacactgcaagggccctgactatattagcccaacagcaaactaaaatgcataacaccatctgcctaaaccacttggctttggattatttgcttgcttctgagggaggggtttgtggaaagtttaagttgaataattgttgtctaaaaatagatgacatagtaaaggtgacagaaaaaaatgctgattgcatgactaaaattgcccatgtgcctactcatccttgccttatacctctcctaattaatattataaaaggttttatagaaaccatggttgaaagaaaagcagcctcccagttgctactcatcaaatttgccaacaggtaatgactgatgatgatccctgatggctacagatgcaccctgtacaacaagagaggggaaggaagttggagatctaactaagagacataaccccccttgtctgaaaaggcagctgtgtgccttttcagttctgctcaccttataccttccttcttgtaattatgtagcaactatgtaccctatgtcaaagccagcagccctgctaatcctgctccaagcattgcttatcagtttca

SEQ ID NO: 179 - DNA, 5829 bp, artificial
  ss1578 sequence
  misc_feature (381)..(480): n is a, c, g, or t
tgggtttggggctcggcctttggatatgagtccgcttagccatgtcagcatgaataaacactgtttcctggaaataagcctcagtgtcctatttctctgtgcaagattactgcaacatttcttgggggctttccgggatgatgatttcacctcccttgtcactggggtacaacctctgggacactgggagaggtgacctcgcctggtgtcagcagactgatggatctgtaggggactagccctcccagtgtgctggggcaaggaccctaggagcacaagagaatctggtgaggcccaggaaccagccgagggagccccgcccatcacaccggtaagaacccagattcagttttgtaagccctacccttagaaggagaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagaaagcgagcctctccggcccctggctgaagcctgaatagaagagaactgtaaaattttgatgactcgaattatggcctcctcaaaatgcagaccagtacccaagaagcccacttttatctggggagccagaggaagttcctccaccttctgcaccactgtatcccccactgccaccagcactccctacccccgccgcagctgaaaccctgccagagaccacctgtacgcctgaagccacctcacccacaaagccacccaagatgcccctggccatagacatcccagagccaccaatcttgaccccctatgggaacacctgctgacagccccctcctcagaggtgccaacttcctcctaggctccaaaatgccctacaaatgcccctaagggaaactcaggcgcccctctactatgatcaggagggtcaatacaaggagtacaatatacttgcacatatcaaccttttgccaccactgagctcctgaactggaagaaccatcctccctcagtcactgaaaaaccccaggctgtgactgatccagacccataagccctcttgggctgattgttgccaactactcctggccctattcaaccctgaggaataccactttaacatggttagaagaacacacaccggctgggatagtaaatgcacaggcttctgcccagagccaattccctgaggaagattctcactgggaccctaatgatgctcagaaatttcaaatgctcgagtgttgccaagagactcttttaaacagcatgaaggaaggcggaaaaggctaaaaataggagcaaaaccacagaggtgctccagggacctggagagagccccagtctattttacgagaaggtatgtgaagcgttccgcctttatacccccttccacccagaagccaccaagaatcaatgaatggttaacacagcctttgtcatccaggcccagggagacatccaatgcaagctgcaaaagtgagagggttttgctagaatgaatgccagctaaatattagaggctgcaacaaagctatttgtcaactgagaccaagaagccagataagaagcagaccaaaaaatgaagaagaaggtagatctacttgctgctgccctagtggatcaatcaggacactcctggagaggtaccctgctgggccagggccaaggtcagggaagaaacttatgagaaggaccaccttggcctgagaggttactgggatgaaaccagtgttctcactgctgccaagaaggccactggaagaacaaatgcccccagtggtcagaaaattgttatccagcttctggacagagagggagaggcaggatgattcaaggatgataccaaccagtacaacaacaataggaggcccctgagaatgattttgttgatctggctgccatgggaaactgtgaggaagactaggacagactgggctccattctgttaggcccccaggagcccatggcagggggctggcccattgacttcatggtagatactgagacagaacattctgtggtgacttaacctgtaggccctctctcacagagataaaccactactgtgggagccactggcgaccaaacccatctccctttcttactgcctcagtgatgcaatttgggtggccatgaagttgttcatgaattcctatacctcactgactgtcctgtggttttgatgggttgggacttattgggcaagctacaggcccagataactttcaactcccatggccaaacggccctgaccctagggaggccaggggcaaagatcctgactctcccagtcccccaaggagaagagtggcaactctacagtcatagagaggccactcagggacctgagcttccctttaagctgcctggggtatgggctgaagacaataccctgggctggcccaaaacataccccccataacagtagagcaaaaaccaggggtggaacctgcctgtcagaaacaatgtgtcattctccgcagagcacaaatagggatccagaaacatctggagagacttctaaagtaaggaatcctccaacattgccagtcgtcttggaatacacctctcctgccagttcaaaaaccaggaatagatgactatcagccagttcaggagcagtaaacccagccaccgttaccctgaacccagtcaaccctaacccctacgctctcctgggccttacacctgctgaggctaccttctttacatgtctggacctccaagatgccttcttttgcattcacctggcccctccaagccagccaatcttcaccttccagtgggaaaatccagaaaatggtgacaagattgcctcaaggattcaagaattctccaactatcttcagcaccacattagcctctgatttaaaagacttcccagcaaaccaatgtggctgtatgccactccagtatgtggatgacttactactggcccaacaaattcaggaagaccatatggaagggacacgtctgctcctcatcctcctttgggaggctggttacaaggtttcaaggaaaaagacccagatcggtcaagaaaaagtcaaataccttggctttcacctaccccaacgacaacatcaactcagcccagagagaatgcaggctgtctgcttgatcctggttccatctacccaacgtcagttttgggaatttcttggggccacacgtttctctagaatctgggtacccaacttctccattttggcaaagcccctttatgaggccacaaagagggaggaatgggaacctctgtgggaatgagggcaacaaaaggcctttgaagagaccaagggagccctcaccaacgcacctggcctgggactcccagacatcaccaagcctttcttcttgtacatgcacaaaggcactggtgtcacagcaggtgtcctaactcaaatgttggggtcatggccttgtccggtgtcatacctttccaagcaacttgactccattgcccaaggatggctaccctgcctacaggaacttgcagccacagctctcttagggtcagaggctgataaattgactatggggcaagaattaacagtctgaacaccacactcagtactgtcattaatggaatataagggatgatactggctaactaatgcctgggatggtcaaatatcagggaatattatgtgaaaatccatgcattcacctagaggtagcaaggaccctaaaccctacaaccctactacctgtggggccaggccagccaaattatgactgtgttgaagtcatagatgaagtatttttcagctgaccagatttaacagagcagcccctcaaaaacccagatgctgaatatttcaccaacaatagcagttttgtaaaagagggagaatgccttgctgggtattccctggtgaccctacattccaccgtggaagcaaaactctgccaaagagacttctgcgcaaaaggaggaattcaccacacaaacccaagccctccactggcagcagggatacatgtcaatatatacaccgactccaaatatgctttcaccaccctccatgtacatggggctttatataaagaaaagggtctaatcaactcaggaggaaagaatataaaatatggcaaaggaatctttgaaatcttagatgctgtgtgggcacctagaaaggtggcagtcatccactgttggaaactcaaagggggggataccagagttgcttggggaaactgtaagcagatggagaagtaagacaagcagcctccaagggggtaatagaatgagcagccctgactatggcactatttcctagttcattgggagaatgggaccccaactactcacaacatgaaaacacctggtttaaaactgaaaatggaaactaccttccagggggatggtggcaatttgaagatagctgaacagcaatttctgaggccctagccccagcctctgtcaaacagtttcaccaggagactcacattggccgtaaggtccttgagactacattgggccaatatttctacatccttggcttccccagcatagctgggtgatatgccaacaatgtgaaacgtgtgtccaaaataacccacatcagggacccagggctgcccctggagtacagagtgttggagggaccccatttgaaaacatagttatggatttcactaagcttcctggagtctgaggctataaatacctgttagtctttgtgtatacattctccagctgggaagaggccttccctacttgcacagagaagccacgtgaagtggaccaatttctcctaaaggaaatcacttccccatttgggattccaatcaccattggattggacaccaggccagcatctgtggctgaggtggtacaactggtggccaaaggggtgaagatcacctggaagttacacatggcctattggccccggagctctgggaaggtggaacaatgaatcggactctgaaaccacaattaagcaaactgtgtcaggagactcacttacagctcttgggaccagctcttgccaatagccttgctaagaattaggtccagccccactaagcaaacagggttttccccttatgaaatcctctatgggcatctacctcctctcattaaggctatggggggacttaaaggaattaggaaacctcaccatagaaaacagatgcaggcgctaggacccaccctagccaccctccatcaatgggttagggaacggttacctgtaagcctaaccacagacacccacctcttcaaaccagggaatgctgtgtgggtaaaggaaaggaatatctagccattaaaacctctttggaggggcccatttactatcatttcacccacctctactgcagtcaaggtggcagaggtggctccttgcattcagcagagtaaaagcagcatctcaagactgggagtgcattcctgatctcttgacactgtgcaagctgaccattcagaggaaacagactgctaccccagagaccctagaagactgcagtcctgctttagtcactctgaaagctgactaatctatgcatggcagaagcttgaagaatcaggataaacagagttttttctttttttttttgtctttctttcttttttttttttttttttttttttttggcttttatcttttttttagggcatgtgcaactatgtaacatggactatccaatcagaatttacagaatgtatgttaccttacaagggggactaagggatcagaatgtaacaggaaaactagcagaggtatataaggcaatgatgggctcagcctttggatatgaatccgctgagccagtataggcacaaataaacacttcttcctggaaataagacttggtgtcctgtttctctgtacaagaa

SEQ ID NO: 180 - DNA, 4576 bp, artificial
  ss1586 sequence
cctcctccccctcccgctgctcctgtgcccctggttcctgcaatctccacacttctttctccccttcctgcttttctgtgcttccagctcctacagcccctacaccttctccccctcccaccactgttcttccttctcttcctccctgcccccaaaatcctaattcccacacccaaaatgcagcctcttcccctaataacaaccccttttattcccttccccaacgagatctcgatcatcgatatcccgaggccccaatccttcctttaagagaggtttcaagagttgaaggaataatcagagttcatgcaccttcttctttgggagacttatcacaaatttaaaaaaaaaaaaaaaaaaaaaaaagcttagattcgttcacctcagacccaactacctacacaaaagagttccaatatcttgttcactcctatgacttaacttggcaagatatttagattatccctggctctcctctctcctctgaagaaagggaacgaatttggctggcagcccaagcccatgcagacagcttacatactcaagaccccactaacaatcctgttggaactctagctgtgggccctaattggaactatcaggtagactccccagacaggtgcaagagaggccaccttatctcttcttgcctaatagaagaaatgaagaaatccccttcgaaaatagctaattatgataaaattagtgaaataatacaagaaccccaagaaaacccagccctttttatattcaggcttacagaggctattcttaagtatactaccctaaatcgagacagtgaagacagaaaaacttatccccatatacatttcatttcccaatcagcaccagatatgaaaaaaattacaaaaactagaagacagtcctttgaccccacaaagggactttttaacaattaaagctgcctttaaggtctttttaacaataaaaaggaagaacaaaaggccccacaactaaaagagtccatgaccaaataccagcttcttgcttctgccatagagggaaatcctcaaaaaccgaggaacccccacccccatcctctaggcatacaaacttatagaaccacctcccttctgggggcctgtttcaaatgtggctctgggcaaataaatgccctaaccccaagcccccaccaggcccttgtcccaaatgcagtcaaaccagacattggaaggtagactttggcaagccagagcagtccaccatccccacaaccggacacttggcagtgaaactgtggaaagccagggcagcccaccgtctccccaacaaaacccaccttggagaccatcaacatgcacaaatgttgggcctggccatgggagattaatggggcccgaggccaccaggcccccaccttcccgtcaccactctggagcctcgggtatctatggcagtagcaggcaagactgtttcattcttactggacacggaggcatcatactcagtattacctagtttccggggtattacctacacctccccaacttgtatagtagggttaaatgggttgcccactacaccccaaaagactggacctttagtttgcacacttttaatgccattttttgccactcatttctagttattcccacatgtccaacccctataatagggagggatattttaactaagttctaagagttcccgtcgtggctcagtggaaacaacctgattagcatccatgaagacataggttcaatccctggccttgctcagtgagttaaggatgatcctgcgttgcctgtgagctatggtgtaggttacagacagggctcagatcctatgttgctgtggctgtggtgtaggccagcagctgtagctctgattcaacccctagcctgggaacctccatatgccacaggtgcggccctacaaagacaaataaattccaggcatacattcaatttcctacacaaccaaacgcaaagttctcactcctgtgccagccagatccggggcccacctcccagtccttcccacctccctgggatataaatcccattgttcgggacaccagtaggccctccactgctagacatcattctcccattctcataagacgaaaggatcctactaaatttcctaatcaaactcaatatcctattagcccagaagctcagaggggacaaacgcccgcctataattcagcacctcctcaagggctatgtcgtcaaacatactctccattcaacactggtatccttcctgttaaaaaaaaaaaaaaaaaaaaaaaaaaacacacaaagcaaaaaacaaaaaaacaaacccacaccccagatggatccttccaattagttcaggatcttcgccttaacaattaggcattaacccagtggtcccaaatccctatactctcctgtctcatatacctcctaatacttttcatttcttagttctggacttaaaagatgccttttttacaatccctctagaccctgcatgccaggacttatctactttcacatggactgaccccgacactctttggcctctccattaacctggacagtcctttctcagggttttagagacagctcacatttctttggccaagccttagccatagctattaaccactcggggtacttgaggaccaactcacccgccgaggggccagacccagcagctgtaactgggaccctttagtctccatctcctcctgacatggaggactggtcagagtgccccgaccaggtaaaggacatgagattttgctgaccttttccccttccctctcccctttctcttttcaaacttaagctggcctcttttcctccttttgaaacctttgaagacccaagatatttctgttaactctttttgcatacacaattttaaaaagcaagcttgaggaaaatgtcttttcagaattctgaccttgagggaataagtccttctaggagaacttacttttctcgccctgtgccttgagacctgggctctcaggaacacctatcttatctagaccaactctaattcctgagacggagggaaaaaaaaatgggtaaagaaatcttttcaaaacttataaagtagcgagttttatttttaatatctgactcatgactaagcttagaaaatgaagctatgagatttctatgagtttttatgtgcaccatatatgtattaactttggatgatattatcaaaaattaaatgtaaatgggacctacttaattgacttaaaggaaattaaatgcatatagaaatcctcaaaatatggaagggaactggccagaattaattttaggtttatgtgaactgggaaatattcagtattaaattaatatcttgtgttaaagtttgttgatccaattaatatagacatgcctttagagttatcaacattaagagtaaaatgtaactgtacctaggttaaatagaagtcaaatgagatactgagatatcagttactaaacagagaaattgaaggtgtttaggactattaatcatattcggtgctaccctgagctgtttctctataagaaaaacatgtttttagaaattataaaacacagtctgtggttgctttagaaaagtaggatgtgttttcaataagaaggaatgatgaaaggaattacagtttattaaaggaaaacaaagtttgtcttgtagcttatcgttttggaaggaaaaataagggacagaataatatggacgcagaaagtggaagaaagtttgtgggaagtggacactgagagaagaattttgtggatggtcaggagtgactaagttagaacaaacctaattgagtaaattaattttaaaagtaagctggtgcaaaacttgaatttggcttttctctctgctaagagaactaagtcttcttagaatgctactctgacaacagattatgtgaagtccttcgcctttaaataacctgtatttgtttctgagatctcttgcaactttggggaaagtacgacctataattctatctgtccaaatgtttttttaatgaacttcctatcaaattctaattagtttttttgacttcaactaactttgggatggttcagagggcctctgaggcatcccagaggtaggagagggggaatagttaactaggaaaatacatgcagaacatcatcaaatgagtgataagcctcctcagattatacagtagatgtctctacagtaaccaagtttctttgtcaactgcattataatcggattttattttattattattttttttttggtctttttgctatttcttgggccgctcccgcggcatatggaggttcccaggctaggggtccaatcggagctggagccaccggcctatgccagagccacagcaactcgggatccgagctgcgtctgcaacctacaccacagctcacagcaacgccagatcgtcaacacactgagcaagggcagggaccgaaccgcaacctcatggttcctagtcggattcgttaaccactgcgccacaacgggaactcctataatcagattttaaatgcaccctctcaagtcttttgtcataggcagttcatggctttactctgatgcctttgcagaaatgttttctcttcaaggaggtcta

SEQ ID NO: 181 - DNA, 8391 bp, artificial
  mm2664 sequence
aaagggcaccatggaaattgccaaggtcaaaagacagaggactcccggcttctccagctttgcccttgtttctttctctctccctccctttctcgtccccttcctcctgcattaatgtatctgttcatctcctctatctctcaatcgcctgtatttattatcattttaaaataaaagatctctgagagagggaaaaaaaatactctgagctgtgcaggtaaagaggttaaccagcccctggctgtgccctccagctctgggtaaaggcagacatcccctctctcgctgcctctaggctgtaattctggcgaaccctggagggtgaaaccccacgtattccagcccctggcacgcatgctccccccaccccccacctctgtcctcctgccctgaaaagaacaccccacagagcccgtgcacaagatctgacccacggtgcttaggactaatatttaaaatgcagaatggctgtggagggctcccgctcccaagccttgtcgtgcagtaaaaagatataaacagaataaattacctctccagctcggattatgagaatacccatcccctgaccggaattttaagtcctgcctccctcgtagcaccgcacacggctgatttatggaaacccgagcacttctctgcatatttcttctgttcagccaagtgaccgagtttacccttcctatgccattagcgttattaacacctgggcaaccgatcattgcaaatgggccatttctgtgatgaacggaaacctctcctgctgcttctccagggcctagctgcctctggtctctgccttcattttgtgccagggccccggaccatccctggcacctgttcatgagctcctgggggctttgggaggaaacctttcgccctagcaggtgtccagtggctttctggcaagcacacagaaagtgaaaactccacactatttttacacctcagagaatgttccagatggagggcaatgccaccaaggatgagggaaagaaacttaggttcagaggatgtcccttgtggcacaacaggttaaggatttggcatggtcactgcaggggctcagattgctgctgtggcgagggttcgatccctggcctaggaatttccacaccctgtggttgcagcaaaagaaagaaagagagagaaaaaaggaaaaaaaaactgaggttcagagatggcaagagaccaacctcagagttgggatctgaatcttctaggcaccggctattttttgtctttttaaggctgcacctgcagcatgtggaggttcccaggctaggggtctaatcgtagctatagctgctagcccacgccacagccacagcaacaccagatcggagccacgtctgcgacctacaccacagctcatggcaatgccagatccctaacccactgagcaaggccagggatcgaacctgtgacctcatggatactagtcagatttgtttcccctgagccatcatgggaactcctgaatcttctagacccttgatattccaactgtggaccagcagcagcatcacctggaagctggatagaagtacagaatctcaggctccagcccagaaattcagaaccagagagtgtgcaccccccagaaaatgggttgcacatttggtttctacaacattagcttagcaacacccctatattctcaatgatccccttttcactggaggaaacccttatggtataaattctctttgctcagaagcagcaggaactccactcccatggtcaaaccaagtgacatgaaagcagctggccaaaccagtgtcacccatctgggcacccacagcactccatccacttcctcctcaacccacatcgtgtctgtgtccccatccccaagcttgagcaacctgagaccagagactgtgtgacttgactggggacactcaacctctctgagtctcagctgtgccacctataaaaagggcacaataagatctaacttcgagagtcattgcaagggttaaataagacttcatatgtcatagtctaagcccagtgcctggcacagagcaggtcactgagtaaataaacactgaatgaaataacaataatacggaaatgagaacaatggccatttattggatgttgtagctattgtcgttatcctgttttcttctttggagaggtgcttcaaatatttcctaagacaaggactcacttcacagccagttgggagagatgcaatttattactttccagaatatacttaaagataccaacgttgtctaatggaaaattatagggcctatgaagatgagaacggatctgccgtatagtaagagatcaaagccggatgaaggataattaggcaatctgtttaaaagaaatgcatccccccccccaaaaaaaaaaaaagcatcaccaaaggatgaaaagagaaaatgtgcactgtcctacctggaatagtattcagccataaaaaggaatgaagtcatggtacatattaagatgtaggtgaaccttgaaaatgtgatgataaatgaaggaagacattcctgaaaccccacatagtgtctgtttctctttttttaaattgctgcacccactgtgtatggaagttcctgggccagggactgaatctgagccatagcttcgacctatacaacagctggacaatgccagatcctttaactcaaagcactgtgctgggggtcgaacctgtgcctccacagtgatatgagctgctgcagtaagaatctgaacccactgaatcacagtaggaactcccatgtctgattctttctatatgaaatgtccagaataagtaaatccatagagacagaaagcagattggtgatggccagggcttgtggggagaggaggatggggagggattattaatgggtacagactgtccttttggggtaacaaaaatgccctggaactggtcagaggagatggttgcacaacctcgtgagtgtatttttttttttcttccgctttttagggccacactcgcggcatatggagattcccaggctaggggtcgaatcagagctgtagctgccagcctacaccacagccacagcaactcaggatctgagctgcctgtgcgacctacaccacagctcacggcaatgctggatccttaacacactgagcaaggccagggatcaaacctgcaacctcacggttcctagttggattcatttccaccgtgccacaatgggaactccccttgtgagtgtattaaatgcccctgaatggttcactttaaaaagattaattttatgttctatttcatctcatcttaaaagtatggggggaaaaagaaatgcaattgtattatattcagggacttacaggacacccaaacttcactaaaaaattggcgttcgtgctgtggaactgaggtgaaccaggtttgatccctagccgcttgcagtgggttaaggatccggtgttgccgcagctgtggtataggttgcagctgcggctcagattccatccctggctagggaacttgcatacgccgcctcaggtgcaactggaaggaaaaataaaatgagaaagaaatcctggtgcctaaaggagagacttggcaacctatgctaatacctgctgcaggcgctcaggccacaggttcttctcactggcagaaattgctagagagcttgcctcagatacattttggggtccctgagatcaaaatcagcatcaccgtgcaatgccaccagggtgttttttaaccaacagtgcgggacatgggacatggaacccagctttgtcacaggtgcctgatgcctcatgagcaaatcactgcctttttggttctttttcagcccttctgattgttttaggcaaagtctctgcttggtgctagcttgccgacacttgcttacgccggcaggcttggagtctcggcacaacaggagccagctctaatgtaatggcgttgttttgtttttccctttatgcactgccatgcctattatctaattctgggaagtgatactgtttccccatttagactggtgataacggttccctttctaaatagcactgaaggtttcaagaaatgtgaattaggtaatagcaaagatgatgcatgggggagttcctgtcgtggctcagtggttaacaaacctgactagtattcatgaggacgcaggttcgattcctggccttgttcagtgggtaaaggatctggtgttgccatgagcctcagtgtaggtggcagatgcagcccagttcccatgttgctgtggctgtggtgtaggcgggtggctacagctccgattcaacccctagtctgggaacctccatttgccgtgggtgcagccctaaaaagacaaaagacaaaagacaaaaaaaaaaaaaaaaaaaagatgatgcgtggatctggcacaaccctgggtggtgctatgggtttggggctgatatttcaggaatgtgtgcactcagagagagctggtccctaagggcctactccaggtcgttggtgacttctctctgatgaactcacagccccactggattttcagtctgggactggctttgaggtggctgtgctgggtggctaggatcaggttgctcactctctctggtcctcagcctcctcatctgaaagatgggggtgggaggtggaacaaaggccctggaatcagggtgtgcagacctctccctgccttcctgaatcttcatttattcactcgctcattcattcattccttcattcaagcaaatatttgttgaaatactatgcactgggcactctcctgggctctgggttacagatgtgaataggatagatatgatcccggccctcagtgagctgatattttactcagggagacagacagtgagcaagggagaaaataattgatcatttcaaatagcagtaggaaaagaaggtagtgagactgagaatcactgggtgttgaaacaggcactcagccaggctgggcgagggtgaggcaagtggggaactgtccctgagcacaaaatttaaggggaggtgcacacccaaaactcaggaatcaaaatatacagtgtttttcccataatagtttgaaaaatcaaaattaatgcaaaataatccataatgaacaagatggcaatattttagataaagacaggatgtgacagatctgccgttcaggggaaatgagacgtccaagtgcaaggtgaaatcctatcttcatttaaaactattactattttgagggagttcccatcgtggctcagcggtaacgaacccagctagtatccatgaggatgctgatttgatccctggcctctctcagtgggttaaaggatctggcattgctgtgagccgtggggaggtcatagactcagcttggatgccgagttgctgggttgtaggccaggggctatagctccaattcaacccctagcctgggaacttgcctatgcctcaggtgcggccctaaaaagatgaaaaaaaaataagaataataaaataaaataaaataaaaagatataaaaagggttgctagtttagagtttccctgtggctcagcatgttaaggacctagcattgtcacagctgtggcttgggtcacttcctggctagggtttgattcatggcccaggaacttctacatgctgcagatgcagaggaaggaaggaaggaaggaaggtaggaaggaaggaaggaaggaagaaggaaagaaagaaagaaagaaagaaagaaagaaagaaagaaagaaagaaagaaagaaagaaagaaagaaagaaagaaagaaagaaaaagagggaaagaaagaaaaagagggaaagagggagagaggaaggaaagaatgaagtgggttttgaaacccaggtcttcaaataccccagcctggcccatcctctgcccacctcacccctcagaagacagggccaggtcatggaactactagcttcagtttccctcatctgtaacctgggactaattatagcacctacctcctagggtggaggagtcacagaaactgaatacacaagctaagggctcaataacttttattttaaaaggaagaaaaaagacactttcccacctttcctctctccctgctctccgtcccccacccacccccattccgctggttctccccaaaaggaggaactatggtactccttcttcaaacatttatttaattctttagggttttgtttttttttttttttttttggaggggggcaggaaggattggtgaaggtaatcagttttcggacttaagataaaaaatcgcagcaaagggtcgacttgactccttataattaatggggcggcttgtaataggattctcctgcctgtggcgctcccaggaaacacctttttacataagatattgcccacgccggagtggcagcggggtgatttatggggttccttgctccagaaaacctctcctggggttgcccagccagtggaatttatcagggagtttggaagccaggcaagaaacctgcccctgacatttttggtggagtttaaaaaagcacaaacactggggaagggagaagccaaggggacggagacgagacggggttgtgtgagggggtcagattagttgggttttccacaagcagagcctgagataggggttcctggcgttcggtttatcaagggaggactcagaagggagtgggaggggacagaaggaggggaggactcacgtggaagtcaggtctcagccggatcccacagggagccctgctctgtggaggggatccagagctgttcccaccttgaggtggcatgagagcctgccttttctcatcatcccatgcacctctggacacagcggcccccattggctcttctctggagaaagaggacagccctgggctgtcagcagccatcactctcactgatcagctgcacccacctgacccagatgcgagtcagtgggcagcaatcgtgtccactgcagaggcaaaggtttctcaggatacgagatgaagatcaaggctggggacagagcggagggaggcgggaggaaggatgtagtctcatgctccgctctctccctcaggcttaaagggaaaaccggagtcgggaccacagcctgcaaggctctccatgatctggtggcccttccctccatctatgacactccttagctctctgtccatcttccaccatcacctaccttttctcagtcccactggcctcctcatagcttcccacctcaggacctttgcacatactgttctttctgcccttcccccataggtctcacatgctccttcatttctttcagtccttaattcaaatgtcaccttttcaaagaggacttctttgaccatctatctcaactaatcaacagatgaaggcacttaaatagaaaaaccggctgtgggactggagcctcctggtgttctctgaacctgttcttccactacagaatgggatcaataaccccgactttatgcaaagagcttcagtaaatgctcagccactatcctggtagggtgttggcaggatcatttaagttttccagaagttgcttcttcaaagcagtccaggacttccctggtagtgaagtgggttaaggatccagcattgtctctgctgtggttcaggtctctgctggggtgtggattggatccctggtcctggaacttctgcatgtctcataaggggccaaaaaaaaaaaaaaaaaaaaagcagcccagtggtttgtttagggacttagcgagatgtgctacctcattgggttcaccacctgtccatcatcactgctcagcaaaccaggtcctgcagggggcgggctgagtggtccacggccttctttcctccatcgcggagctattctggctgtaattagaatccatgcctgagggatggggggacctgagctctaccattttaatggagctaaagaaacctctctgtgagcttccatttccttatgtgtaagacataaggagttcgcccagacactgagtagttgcttgataaagccatagcaattaaaacaacatgccaaccccgtggaatacacaagcagaaagaatccagagacacctgctcccccaataaaaagcccagaagagatgagacttgcctaaaactggggttccccacctccgccctactgacttttttgaggcccagttactccttggggtggaggctgtcctgtgcattggcgggtgttgggcagcattgccaggccccacccactagtaccagagcacctgccccctatttgtagcaaacaaacttgcctccggcctttgccaaacaattcccagctcatatcctcagagctgctctgattggacagtttggctgctgggcccgcctttgaaccaatcgccatagccaggcaaaatacagggcttagattggctcaggttggggtcacacactccttctctccttttctgcaggagttgtcagagcctttacagaaa

SEQ ID NO: 182 - DNA, 4140 bp, artificial
  ss1602 sequence
cctcctcctcataggtgccaaggtgctttacaaatgccactgagggaaactcgggggctcctctactatggtcaggatggtcagatataaggggggcaatgtactttcatatatcagccttttaccaccactgatctcctgaattggaagaaccatactcccttattcactaagaaaccttgggctatgattgatctaatgcaatccatcatccagacccagaaggccacttggactgattgctgccaactactcctgactctgttcaacactgaagagcactgctgaattatttgggccactttaaaatggttggaggaatacgccctggcaggaacaatgaatgcacaggcttatgcccagagctagttccctgagggaaatctccaatgggaccctaatgatgcctgggaatttcaaatgcttgagtgttaccaataggctctcttaggcggcatggaggaagggaaaaatgctatgaacatgagcaaaacctcagaggtgctccagggacctggagagtgctgaagtcaattttatgagacacgatgcaaagcattctgccttcacacccccttcaacacagaagcagctgaaaatcaacaaaaggttaacatagactttgtcagccaggaccagggggacatctgatgtaagctacaaaagttaaagggcttggctagaatgaatgccagccaactattggaggttgtaacaaaggtatttgtcaatcaagaccaagagacctgacgagaagcagaccaaaaaatgaagaaggtagatctgctttctgccgccctggtggatcagcgtggacactcctggagaggtgccctgccaggccagggctgaagtcagaaaaggaactgacaataaggaccgacgataaggaccgccttgcccagagatgaaattgggatgaaatcaatgtgcccactgccaagaaggtcactggcagaacaaatgccttcaatggtcagagaattattacccgcctcccagatggaggggaaaaagcctggtagttcaaggacagtacaactagtacagtgaccatatgaggcccctgaagacatttttgtaggtctggctgccatgggaaactataaggaagactaggacagaccaggccccattttcttaggcgcccaggatcccatggtctgaataactgtaggggccatcccattgacttcatggtagatactagggcagaacattctgtggtgacccaaccggtgggctgcctcatgcagagataagtcactattgtgggagccatgagtggccgagcacatcaccctttcttactgtctcagtgatacaatttaggtggccatgaagtcattcacaaattcctataccaccccaactgccctgtagctttcatgagtcaggacttattgggaaagctgcaggcccagataactttcaatccaatgcccaagcagccctgaccctagggaaacaagtagcaaaattcatgactctcgaggtcccccgaggagaatggtgtctctacagtcttatagagaggccgcaacagggacctgagcttcccttcaagctacctggagtatgggatgaagataatctccccggactggcccctaacatacccccaataataatagaataaaaaccaggggctagacctgctcaccagaaacaatatttcattcctcacaaagcacaaattgggatccagaaaacttggagagacttctaaagtatggaatcctctgaccctgccagttgtcttggaacatgcctctcctgccagttcagaaactgggaacagacaactatcagtcagttcaggacctatgagcagtaaaccaagccattattaccttacacccagttgtccctaccccctccactctcttgggccttatccccactgaagctgccttctttacatgtctagacctcaaagaagccttcttctgcatccattttgcccgtacaagtcaactgattgctttacaatgggtaaaatcctgaaaacaatggcaagagccagctgatctggactagattgcctcaaagattcaaaaattctccaactaccttcggcactgtgttaacctctgatttaaaaaccttcccagcaaaccaacatggctgtacactgctccactatgtggatgatctactactggccggacagactgaggaggattgtatggaaggaaaacaactgctccttgccctcctatgggagcttggctacaaggtttcaaggaaaaaggcccagatctgtcaagaaaaagtcaaaccttggctttcacctatcccaaggacaatgtcaactcagcccagagagaaagcaggctgtctgttcgatcctggttccatcaacccgaggccagttttgggaatttcctcagggccatgagtttctatagaatttggatacctaacttctttatcttacaaagcccctttataagcccaccaaggaggggggagaacagaaacctctgttgtgggaatgagcacaacaaacggcctttgaagttatcaagcaggccctcaccaaccacctcgcctgggactcccagacatttccaagagtatcctggcattgcagtgggggtcctggcccagatgttggggtcatggcatcgtccagtggcatacctctccaagcaacttgactctgttgcccgaggatggccacccctgcctatgggcacttgcagccacagctctcttagtgtcagatccagacaaagtgactatgggacaagaattaatagtccaagtgctacactcggtattgacattaatggagtataagggagaagactggctaactaatgcccggatgggcaaatatcagggaatgttatgtgaaaacccatgcattcacctggaagtagtgaggaccctaaactctgcaaccctactacctgttgggtcaggccagccagatcataattgtaccaaagtcatggatgaggtattttccagctgacccaacttaatggaccagccccttgaaaaccctggtgctgagtatttcaccaacagtggcatttttataaaagagggagaatgccttgctgggtattccatggtgatcctgaattccaccactgaggcaaaatctttgccaaaaggaacttctgctcaaaaggcagaacatcattgtgccagccctcaaactggcagcagggacatgtgtcaatatatacacactctctaaatatgccttcaccccccccttcacatacctggggctttatataaagcaaagtgtctaataaactcaggaggaaaagacataaaatatggcaaagaaatactttaactcttagatgctgtgtgggcccctaaaaaggtggcagtcatacattgccagggacctcaaaggggagtgccatggtcatcagggaaaccctaaagcagaccaagaagccatgctctcagcctgcaaggagatgatagaaccagtggctctgactgctgcacagttccctagtccattggcataatggaaccctaactactcacaacatgaaaacacttggtttaaatccaaagatgagaactacctcccagatggatggtggaaattggaaaatggccaaatagcaactcctgaggctctagccccagcctttgtcaaacagttttaccaggagactcacattggcctaacagctcccaagaccacactaggctgacacttctacatcccttggctttccagcataacccaggtggtatgtgaacaatgttaaatgtgtgcccaaaataacccacatcaggaaaacctaagattgcccctgaaatagagtgttggaggggccccatttgaaaatatagttgtctacttcactgagcttccccaagtccgagagtataaatatgttagtctttgtgtgtgctttctcaggctgggcagaggccttccctacttgcacagaaaagacacatgaagtggcccagcttctaaaggaaatcattccatgatttcaactaccagtcaccaaattgggataggataatgggccagtgttcatggctgaggtggtgcaattggtagcaaaggggttaaagatcacctggaaattacacatggcatatcaccctcagagttccaggaaggtggaacaactgaaccaaact

SEQ ID NO: 183 - DNA, 13290 bp, artificial
  ss1611 sequence
tgaagttggtttggggggtttgcagcagacttcctgatgggagggactggtgcctgctcactggtagatggagttgattcttatccctctagtgggtggggctttgtctctgggtgtgattagaggtggctgtgtgcctgtttgctgatgggtggggctgtgagcccacctggtttgttgtttggcctgggcttctaaactctgatggatggggccaggtatttccaaaatagccacctctggaggagtacatgctgatgattattcctgagacctctgcctccaatgtcctcccgcaacaatgagccacagtcactccctgttttaccaggttatctttcaagaactgtagtcacatctaacccagattcctatggagtctctgttttgccctgtgacccagtgtgcacagaagcctgtgtgtgccttttaagagtagagtctccatttcccccagtcctgtggagctcatgcactcaagccccactggccctcaatgccaaatgctctgggagctcctcctcccaatgccagtgaggcagaatattaactcaggtagtcagtgtaggagcatgggcttcaatacattctttgatatggctgttgattaacatttgtggcttaagggctccagggggtagcatttccaaaggccttgttttattataagaaatgcgtgttccccacagactttgtttactatagaaaatgtgaatctctagcccactcctcaactgataaaagaggaatcagaggaatggtaaaagaaaaggactcacacacaaaaaaaccccacagaacttgcaggacatttctaaccccaaaagccctattggacaaggactaatataggtaattgaataaggccaatgggagaagaccacatctctctggaccccacattggtacccctcccccaactttggggaataaaaacccgtataggacagtagagaaagggggtgctcttctcccccctcccagtaaccctgggatctatcttctttcctttaataaaaacattgcttgcttgctgcctgtgtattcacagagttcattctttgaccactatgaacaagaacctggattctagtaccatctttctggcatcatctttttgggggctcatctgggatccaatcccagcttgcactttctacgttttttcagtttcatttgcttctgaaaggagggcaaatgtgtaaatgagtgtatggccgaccagagacagacaaagtgagttcaggaaaattttctttcccatttcccctacaccaaagtctcttctatgtactatagcttttgtaaaatatttgggaaatcacagttactgtattcctgaaggttaccaattgttaaaaggcatgtaagaaacaaaatgttgtttttgtgaatattaaagggcttaaaataacttcttgggtgcaggaagcactgtgataacctctgagtgtgtgtatgagtgaatgtgcatcctgattcacttgtgcttcgggttcaagtttgtggctccacggccttagcaactactgagtctgagtgggtcctaaactgcagttctgcagtgacctcatatggcttatggctgtaacagactctgagggttctcttccctccctgtgagttcagtccaactttggggcttatatgagccagccaattgctaagaggcacctaaactcccaagaggagggtggccaggtggacatctgaatggccatcttctgagaagggatcaccctcccttgttttgtctgcaacaccgatgcagggtgggcatacagggtgggacctaacccagaaatccaggcaaagatttcaaaaggattttctggagattatggtgtaaaactaatctgatcctttatcatttcatttgctattacttcaaatagagctgtgggggcagaggaaacagacctctggatattaagaccaccctgagttgttaccatacctgtgggggagaaggagttaataaccagtattcatccaacttaggccaagtgtttagcctcagagcctgagcatattcagttttgctttttgctatttacttttaccctggttggagaagtcgacagctggtttatcgaatttacctgttaactgtggcttaggaactttcttgatattaatagagggcatgtcagaatgagcatcttaggattcaaaaactcagggcaggacctgtatgcctgagttttcttcacctctgtccagaggcaggtaatggggagggatgatgggaagagaggctacgctggttaattccagtcagcctgaggtcagatgggacatttggccactaatgtctagtcgctccataagagagggatgccctcacataaccaagaaagggaaataggcactggatgctagtcttttctctctttcagatgggagccacatcctcaagcctggtgcatggctcaatagcaactcccctgacatgtgccttgaagaaatagaaaaagtttgagcctgagactctgaaaaaaaaaatcatttaattttcttttttctttttttttttttttttttttttttgtctttttctagggccactccagtggcatatggaggttcccaggctaggggtctaatcggagctgtagctgccagcctatgccacagccatagcaatgtgggatatgagccatgtctgcgacctacatcacagctcacagcaacgctggatccccaacccactgagcaaggccagggatcaaacctgcaaacttatggttcctagtcagattcattaaccactgagccatgatgggaactccagaaatgtttaattttcttttgctcaaaagcctggccactatataacctgtcggacagagagcaatggccatctgaaggctctctagattataatactattttccaattagacctattttgtagaagagaagggaaatggtcagaggtgccttatgttcagatcttgtttacaatgagggaagacactacactgaggaaggcttgtgcactcagtacattatgccaactccctcgggacataggtgtccaccatattctggcccaactggtccagaccctccagaagttaatcagccttctccaatacttcccaaggctccacctctcccccctctagtgccaaagttatatccctttttaatccctttacaagaagtagcaaacgagaatggggaccaatacaggtccatacacctttttcacttcaggacttaaggcagataaaatcagatttgggaaaatttgctgatgacccagatagatatatcaaggtctttcagggtctcatgtaatcctttgagttagcctggaaggatgtcatgttattactacaacagacattgattataagtgaaaaaagtcttagagaatgctcaaagatagatgaatggtatgctataagtgccagaggaagctcaggcgaggaacaaacaagattccccacaaggtgtcaggcagttcctatgagtgaccctatttggtctgctgctgagggagataaagaaaactggcatagaaatcattttattacttgtaaagttgagggattaaaagctcaggagtaaagcccattaaccactaaatcccgttatccactccaaacaatcagaggtttgtcaaggggaatgagaaagtcccatggctttcttagaaaaactcaggcattgagaaaacatacaccaatggacccagaatcaatggagggccaaataattcttaaagacaaatttataactcacttggcaccagatatacagagaaagctccaaaaattggcttttggccctgatcaggacctggagcacctccttaaagtagcaactcaagtatactataatcaggaccaggaagaatgaaagaacaagaggagagacaaagaaaagtctgaggctctaattatggcactacagggagtcaatctgggagctttcaaggcgagaggactagggcagagacctaagcctggagcctgttacctctgtggaaaagagggacacttgaaatggaaatgccccaaggctcagaccacagcacctaggccatgtcccatatgtcagggagatcagtggaagaaggactgccccccaaaatgatggtacctggggtcaacccctcaggcccaggatcaagactgatgggacatggggctttccataatggctcctgtccttatcaccactaaggagcctggtgactctaaatgtagaaaaacagcctattgacatcttcttggatatgggagccaccttttcagtcctcctctccaaccctgcacccccccttcaaataaatctgccactattcataatatttcttgcaagccagttataaaattttttacacaacatttgagttgtgactggggagtgcattttcttctctcatgcttttctgattgttccagagcatccaacttccattttagaatgagatattttgtcaaaggttaaagcctcaattcacataagaatggagcctaatcaaggtttatacctgcctttgatggaagtaggtattgacccagaagtctgggccataggaggaaaaaataggaagagcaaaaaatgctcaaccagtagaaataactcttaaagatcaaaatttctttccttgacaaaagcagtatcctctgagacccaaggcacgacagagacttatcccaatcatcaaacaaaacaaaacaaaacaaaaaacctaaagaaacaggggttattaatcaaatgtaacagcccctgtaacacccatgtattgggagtaaaaaagcctaatggggattggcgcctagtgtaagaacttcctctaataaatgagacattggcctcccatccagtggtgcccaacctctacattctcctctgacaaattctagaaacagcagcatgggttactgtattagatttaaaagatgtctttttttttttctgtattcccttgactaaggctttgcatatataaattctcaaactgtggagggtaactggccagaattaatgtttggctcaagtaaactgggaatcattcagtattaaattaatatcttaaattagaattgaagtttgttgatctaattaatacagacatgttacagttatcaacattaagtataatatcttgtacctaggtttaatagaagttaaatgagacactgagacatcagtaactaaacagaaactgaaggtacttagaatgattaatcaatatgtttagtgccatcttgagatgttctctataataaaaaaatgtttttagaaattataaaggacagcctgtggttgctttggaaaagtagaatgtgtgtgctttcaataaaaaaggaatgatgaatggaattgcattttattaagacaaaagatagtctgtctatagtttgttgctctgggtgggaaaaaaagggacagattaatatggatacagaaagtgaagcaaggtgtgtagggagtagatacatagaaaaaatatttgtgcattgtatggactaagtttagaataaatttaattgagtaagttaactttaaggtggtgccataagtcatacccctcataaggacaagttacctgtgctattataaatctgaatgttgcgtctatgttcctgattattcacagaatgtgtctgattccctgctagatctccagcagcagatttataagatgtcagatccagatccagcttttataactgccctctggaattggttgacctcctcctcctggtgaaaatatttcatcactatagccatcattgtgatcttaatccttttatttggagcctatataattaattgtatttctcatttcattatatcccagttagaagctatcaaccttcaaatggtgatggaaggggtacccaatgtaatgcattgaagcccattcaactgtcccatgagtggagacctaactgctttcccctaacaatgccctttttcagcaggaagcagtcagagaggtagtcacccctttccccctgcagttagagtctccaactctagagggggggattgaggcagaatattaactcaggtagtcagtgtaggagcatgggcttcaatacattctttgatatggctgttgattaacatttgtggcttaagggctccagggggtagcatttccaaaggccttgttttattataagaaatgtgtgttccccacagactttgtttactatagaaaatgtgaatctctagcccactcctcaactgataaaagaggaatcagaggaatggtaaaagaaaaggactcacacacaaaaaaaccccacagaacttgcaggacatttccaaccccaaaagccctattggacaaggactaatataggtaattgaataaggccaatgggcgaagaccacatctctctggaccccacattggtacccctcccccaactttggggaataaaaacccgtataggacagtagagaaagggggtgctcttctcccccctcccagtaaccctgggatctatcttctttcctttaataaaaactttgcttgtttactgcctgtgtgttcatggagtcaactgctgtgaacaagaacctggattctggtaccatctttctgggatcaccaggtccccaggcatgggaacctgatgtggagctcaggattctcactactgtgggtgaacctctgtgatatagttagttaccggtctgtggactgcccacaagcaggtatggacttgcttatatcacataattgcccctcctaccatcttgatgtggcctcctctttgtcttctggagtaggatatcttttttgatatagtttccagtctattttgttgaaggttgttcagcagttggttgtagttttcttgcttatatgaaagaagggagctccagtccttctacttcaccatcttaatcccatttcctaacctaggattcttttctttttcttttcttttcttttcttttcttttctttctttctttctttccttctctctctctctttccttccttccttccttccctccttccttccatcctttcttcctttctttctttctttctttctttctttctttctttttctttctttcttttctttctttcttttctttccttccttccttccttccttccttccttccatcctttcttccttccttctttcttgtctttttgtcactttgggggggatgctgcacccacaacatatggaacttcccaggctaggagtctaatcagagctacagctgctggcctatgccacagccacagcaatgcagaatccaagctgagtatgagacctacaccacagctcacagcaacacctgatccttagcctactgagcgaggccagggatcaaacctgcatcctcatggttcctactcagattaattacttttttttctttttttcatttttttattactcaaatgaatttatcacatctgtagttgtataatgatcataacaatctgatttcacaggatttccatcccacagcccaagcacatccccccaccccccaaactatctcctctggagaccataagtttttcaatgtctgtgagtcagcatctgttctgcaaagaaattccgtctgtccttttttcagattcacatgtcagtgaaagcatttgatgttggtgtctcatcgtatgtctgacttcatttagcatgatagtttctaggtccatccatgttgcaaaaaatgctggtatttcgttccttttaatggcggagtaatattccattgtgcatatgtaccacatcttcttgatccactcctctgtcaatggacatttaggttgtttccatgtcttggctattgcaaagagtgctgcaaagaaaaggggagtacatgtgtctttgcgagtcatggttttctctggatagatgcccaggagtgggattgctggatcaaatggtagttctatgtgtagttttctgaggcatctccatactgctttccacagtggttgcaccaatttacaatcccaccaacagtgtcatagggttcctttttctccacaccctctccagcacttcttgtttgtagacttttggatgatggccattctggctggtgtaaggtggtacgtcagagtggtttagattttcatctctctaataatgagtgatgttgaacatcttttcctgtgtttctcggccatctgtatgtcttctttggagaactgcctgtttagaccttctgcccattttttgatggggttggttttttttttttttttttttttttgctatggagctgcagaagttgtttataaattttggagattaatcccttgtcagtcgattcacttgcaaagatgttctctcattctgtgggttgtctttttgtgttgtttagggtttcctttgctgtgcagaaactttgaagtttgagtaggtcccatttgtttctttttgtttttattgtcaatgctctaagagatggatctgagaagatgttgctgtcgtttatgtcagagtgtttggcctatgtttttctctaagaattttatagtgtctagtcttatatctaggtctttaatccattttgagttgatttttgtgtatggtgttagggagtgttctaatttcattcttttccatgtggctgtccagttttcccagcacaacttattgaacaagctgtcctttctccattgtatagtcttggctcctttgtcatagatgagttggctgtaggtgcatgggtttaattctgggctttccatcctgttccactgatctagatgtctgtctttgtgccagtaccatgcagttttgacgactgttgctttgtagtatagtctgaagtccgggagcctgattcctccagctccatttttctttttcagggcgtctttggctattctgggtcttttgtacttccaaacaaactttaaaatattttgttcgagttctgtgaaaaatgttcttggtaatttgatagggattgcattgaatctgtagattgccttgggtagtatagtcattttgatattaactcttccaatccatgagcatggcatatctttccatctctttctgtcatctttgatttctttcatcagtggcctgtagttttcagagtacaggtcttttgtttctttaggtaggtttaccgctaggtattttattcttttggatgcagtggtaaacgggattgcttcactaatttccttttctgccttttcattgttagtgtatagaaatgccgtcgatttctgtgtattaattttgtatcctgtgacgttgccaaattcgtggatgagctctaacagttttctggtagagtctttaggattctctaggtatagtatcatgtcatctgcaaatagtgatagttttacttcttcctttccaatttggattccttttatctctttcacttctctgaggctgtagctaggacctccaaaagtatgttgaagagtagtggcgagagcagccatccttgtcttattactgatctcagtgggaattccttcagcttttcgccattgagaatgatgttcgctgtgggtttgtcgtatatggcctttatcctgttgaggtaggttcccgttatgcccactttctgaagggtttttatcagaaatgggtgttggattttgtcagaggctttttctgcgtctattgagaggatcatatggtttttattcttcagtttgttaatgtggtgtatcacactgatggatttgtggatattgaagaacccttgcatccctgggataaatcccacttgatcatgatgtacaatccttttaatgtattattggatgcggcttgctagtattttgttggggatttttgcatcgatgttcatccgtgatattggcctgtagttttcttttcttgtggagtctttgtctggctttggtaccaggatgatggtggcctcatagaatgagtttgggagtatcccttcctctgcaattttttgaaatagtttcagaaggataggtgttagctcttctctaaatgtttgatggaattcgcctgtgaagccactggtcctggacttttgtttgttggaagttttttaaccacagtttcgatttcagttcttgtgatgggtccattcatcttttctatttcatcttggtttagtcttggaagattatacttttctaaggatttgtccatttcttctaggttttccattttattggcatatagttgcatatagtagtcttttatgatcctttgtatttctgtgatgtccgttgttacttctcctttttcatttctaattttattgatttgagtcctctctctttttttgcttgataagtctggctaggggtttatcaattttgttgatcttttcaaagaaccagcttttcgtttcattgatcttttctacggttttctttgtttctatttcattgatttctgctctgatctttatgatttctttccttctactaactttaggtcttgtctgttcttctctgtcaagctgccttagatgtaaagttagcttgtttgtttatttgagctttttcttgtttcctgaggtgggcttgtactgctataaactttcctcttagaacggcttttgctgcatcccataggtgttggagtgtcgtatcttcgttgtcatttgctgccaggtattttttaatttcctgtttgatttcttcagtgatcccttggttgtttagtagcatgttgttgagtctccacgtgtttgtgttttttgcagtttttttcttgttgttgatttccagtcgtatagccttatggtcggaaaagatgcttgatatgatttcaattttcttaaagttaccgaggttgggtttgtagcccagggtgtgatcagtcttagagaatgttccatgtgcacttgagaagaatgtgtattctgttgcttttggatggaatgtcctataaatatctattaagtccatctggcttaatgcttcattcagggcctgtgtttccttattgattttctgtctggttgatctgtccattgctgtaagtggggtgttaaagtccctgactatgatcctgttattgttgatttctccttttaaggttgttagcagtagccttatatattgtggtgaacctacattgggtgcgtatttaaaattgttatatcatcttggattgatcctttgatcattatgtaatgtccttctttgtccctgaaaatattcttcattttaaagtctattttgtctgatatgagcattgtgactccagctttcttttgatccccgtttgcatgagatattttcttccatcctctcactttcaatttgtatgtgtccctagaagtgaagtgggtctcttgaagacagcatatatatgggtcttgtttttgtatccattcagccagtctatgtcttttagttggggcgtttagtccattcatatttaaggtaattattgatatgtatgttcttattgccattttattaattactttggattggtttttgctgctctttttcctctccttcttctcttgttcttttctgcctgtagacgttcctttagtatttgttgtaaggctggtttagtgttgctgaattctctcagcttttgcttatctgtgaaggttttgatttctccctcaaatctgaacgagagccttgctgggtagagtaatcttggttggaggttttttcctttcatcacgttaagtacatcatgccactccctactggcctgcagagtttctgttgaaaaatctgccgataaccatattggggtttccttgtatgttatttgtttcttctccctagctgctttcaagattttctctttgtctttagttttggtcagtttgattagtatgtgtctcggggtattcctccttgggtttattttgtatggcactcattgtgcttcctggatttgagtgagtggttcctttcccatgtgagggaagtttttggctattatctcttggaatattttttctgtccccttctctctctcttctccttctggcacccctataatacggatgttggtgtgtgttcaacattgtcccagagttctctgagactctcttcatttcttttctttttttttttttttttttttttggctttttgtcttttgttgttgttgctatttcttgggacgctcccgcggcatatggaggttcccaggctaggggtccaatcggagctgtagccaccggcctacgccagagccatagcaacacgggatccgagccgcgtctgcaacctacaccacagctcacggcaacgccggatcgttaacccactgagcaagggcagggaccgaacccgcaacctcatggttcctagtcggattcattaaccactgcgccacgatgggaactcctcttcatttcttttcaatcttttttctctttcttgttctgcacccgtaatttccactaatctgtctggcacctcgcttattcgttcttctgcctcctgtattctgctgttagctgcttcgagtggattttttattttggttattgtattttgcatctcttcttgtttaagttttatatcttgtatctctttgctcagtgtttcctgtaagttatccatctttgcctccagtttatatccaatgtcttgcatcatcttcagcatcagcagtctaaagtctttttcctggaggctgagaatctcctcatcgctttgctggttttctggggcttttcctttctccctcatctgagttatagttctctgtcttttcatttttataggtttttggtgtggtgacctttttacaggtaatagagttgtagcctctcttacttctggtgtctgcccccctgtggctgaagtccgtatggggggcttgctgtaggcttcctgatgggaggggctgatgcctgccccctggtaggaggagctgattctgatccctctggtgggtggggcttagtctctggatgggattagaggcagctgtgtgcctgaggggtctttaggtagcctgtttactgaggggtggggctgtggtcccacctggattgttgtttgtcctggggcttctcagcactgactgatgggtggggccagattttcccaaaatggccacctccagagaaaggcactgctgctgaatattcccgagagctttgctttcaatgtccatccctcacaacaagccacattcacccctgttttcccaggatgtcctccaagaactgcagtcaggtttgacccagattcctatggagaccttgctctgccctgggacccagtgcacgtgaaagtccgtgtgcgccttttaagaatggggtctccgtttcccccagtcccatggagctcctgcgcacaagccccactggccttca

SEQ ID NO: 184 - DNA, 7232 bp, artificial
  ss1615 sequence
tgctgtggtaggggccctcccagaacaaagggaaggcaaggtacacagcatctgtgtgtgtgcatgtgtaactttgtggcagtatggcataatttgtatccatgtgcaactttgtagcatagatgatccaaccagaatttacagaatgtatgttaccttataaggggtaaaaaggggccaaagtgtaaaagaaaaaaaaaaaaagggtatgtaagacagcttcccgctatgttcagggctcagcctttggatatgaatttgctgagccagtgctcacatgaataaatgctgcttcctggcaaaaggcctcagtgtcctgtctccctttatgagaatcctacaacatttcttgggggaaatcatctgggactcagagacagtgatttcacctcctttgtcacttgggtgcaacccctgggacaccaggagaggtgacctcacctgacaccagtggaacaattgatacataggggactagccctcccagtgtgccagggtgaggacccctggagatcaacagaacctggtgaggcccaggaaccagccaagggaacactgcctatcagactggtaagaacctgggttcagtttggtagcctgcccccaagaggcagaagggaagcctgaccacctcctggagttgcccacgtagtctcattggagacaggagacaaaaaccacaactccaagacactgggcggtgagttggagacttgtataaatatgagtgagtaagacagatgatggaagagttccaactcaagcagaagcaagtgttgagtcctgatctgtggttctgtggtgatcctcatatggcctatggtggtttttttcagagaggtcctgacattggggtttatacagtcccaccaatgctaagaggtgcctgaaatagctccctcaggagaacagccagagacagaagaagtgattgtttactgtttcccattctcttcttgtgtgagactgtcatcttttagggggaggaaataagttgaaaacaaagtaaacataaccccttagagtatatgattaaaaaaaaaaatttcaagaagggatattcaggagattatagcattaagttgactcctggaacactacagacattctgtgagatggattggccttcatttggagtgggttggttctctgaggggtcattagataaagaactagttagcaaagtgttaagagtcatcacaggagactcaggacaccctgatcaattcccttacattgattgctggcaagacagtcctctctcagccaccgtggctgaaagcctgcctggaagagaactataaaattaaattggctcaaatgatggcctcctcaaaatgccaactgggacccaagaagcctattttatctagggagccagaggaagttcccccaccttatgcactgttgtaccctccactgctgcctgcacttgcagcagccggggccatgctagaggctgctgcctgccctgagagcaccccctctcctgactcaccatgacgtcaccggtcaccacctctccagagcttctagtgttaaccctgtatactctgaccagaagacaaccagaaaatcaggccagcagaggcagtccctcttcactacagtgccaggggctcctgcagatgccactgagagagaccagagggcctgtctattttgatcaagaaggccaacttcaaggaggccagcgtggttttgtgtaccaatccttcatcaccgctgatatcctaaattggaaaaatcatagcctctcctacacagggaagccacaggctatgattgatgtaatgcagtccatcattcaaacccacaagcccacctggactgattgctgtcagcttctcctgattctgattaacactgaagaatggcaccaaattactcaggcagctgtaaattggctagaggaaaaatgccccggcacaaacactagatgcccaggcttatgtctgagactatttccccccaggagggacccccaaagaaccctagtgttgaagggggacttctgcaactttcatgctaccatgaggctctcctaaatggcatgaaacaaggtgggaaaagggccatgaacatgagcaaaacttcagaggtactccaggggcccgatgagagcccaggccagttctaagaaaggctatgtgaggcattccacctctgtaccccctttgacccagaagcggctgaaaaccagtggatgatcaatgcagcctttgtgagtcaggcacaaggggacatccaacacaagctccagaagttaaagggctttgcaggcataaatgctagtcagttgctggagataacaaccaaagtgtttgccagcatttaccaggcagcactaaagtctgaaaacaacaaaaagatgtgaagaaggcaagcctaacggctgctgccttggtaaaaaaaaaaatggaaggtgccccacagcactgaggccgaggccaaggccagaaaggggggcaacaaggaggaccatctcacccagggccaaaactgggataaaaccaatatgcctactgttgccagaaaggccactggaaaaatgagtgcccccaattgtcagatgattcccagttgggccccaagcagaggggaagagaggccaggtggtccagagctgatatcagctggcccagcagccacatggagcccccaaaaaataattttgtagggctagctgctatgggaaactatgaggaaggcaaggacagactgggctctgttctattaggccctctaagtgccaatggtctgaatgaatatagggggccggcccattgacttcatggtagatactggggcagaacactcagtggtaactcagcctgtgggcccactctggcagaggcaagccaccatcgtaggggccacaggcaactgaacatggtgccccttcctgctgcctagagagtgcactttggggggatatgaagtctttcacaaatttctatacctccccaactagcctgtggcattgatgggtcaggacttactgggaaagctacacgcccagatatcttttaacttccacagccacacagtcctgaccttagggtagccaggggtcaggcccatccaacaaaagcaatatttcatctcttgtgaggcccagatgggaaatcataggcattagtacaaagttccctaaagtacagaattctctggcctcgatagtcacctttgaatgcgcctctcctgcctatccagaagccaggtaccaatgattttcagccagtcaaggacatgtgtgcagtaaatcaagccacagtcaccctacctctggccatcccaaacccctacacactctatgtccatctggcctcccagagtcaattgatttttgtcttccagtggaaaaatcctgataatggtgacaagggccaattaacttggactaaactgcctcaaggattcaagaattctccagctatctttggcactgctctagtgtctgatttaaaagccttcccagtagaccaatatggctgtatattgctccagtatgtggatgacttactgttggcgggacaaactcaggagaattatatggaaagaacacctcactctcttatgagaggctggctacaaagtttcaatgaaggaagcccaaatctcttgggaaaaaaaagtcaagtaccttggttttcacctgtctcagggacgtcaagtcagcccataaagaaaataggctgtctgctctgtcctggtcccgacaacttaataccagatccctgagtttctaggagccataggtttctgtagaatatggatacccaacttctccattttggcaaagcccctttatgaggccacaaagaggggagaacgagacctctgttgtgggaatgagtgcaacaaaaggcctttgaataaatcaagtgagccctcaccaacacacctgacctgggactcccagacacctccaagcccttcttatacgtgcacgagaacactggggtcatggtaaggatcttaactcagatgctggggtcatgacgtcatccagtggcataccttcccaagcaacttgactctgttgcccaaggtggccaccctgcctgagggcacttgcagccacagctctcagtgtcagaagttgataagtgaactatgggacaagaattaacagtctgagtgccatacttggtactaacattaatggagtataagggacaatactggctgactaacgccaagatggtcaaatatcagggaatgttatgtgaaaatccatgcattcacctagagatagtgaggaccttaaaccctacaaccctactacctgtcaggccgggccagccagatcatgattgtgttgatgtcatgcatgaagtattttccagtcaactggatttaatagaccagcccctcaaagacccagatgctcaaaatttcaccgatagtagcagctttgtaaaagagggagaacgccttgctgggtattccatggtgaccccaaattccagctttgaagtaaaagctctcccaaaagggacttctgcacaaaaggcagaactcatcgtgctaaccagagccctccatctggcagcaggaatgcatgtcaatatacatagactccaaatatgccttcaccaccttccatgtacatggggctttatatatagaaaaggtcctaatcaactcaggaggaaaggacataaaatatggcaaagaaattgtcggactcagatgttgtgtgggcctctagaaaggtggcagtcacacattgtcaagggacatcaaggggggacactagccactcagggaaaccataaagcagactgagcagcaaaactcacagcctccaaggggacaatagaataagtggctttgactaccgcactgttccctagtcctttggaagaatgggaccctaacttatcaaaatatgaaaacacctggttcaaaactgagactggaaactatttccaggtagatggtggaagtttgaagatggccaaatagcaattcctgaggccttagccccagcctttgtcaaatagtttcaaccagagactcacaatggccaaacggctctcgagaccacattggaccaacacttctacatccctcagatttccagcatagcctggatagtatgcaaacaatgtgaaatgtgtgcccaaaataacccatgtcagggacctagggccaccccctggaatatagagtgttggagggctcccaatcaaaaatatagttgtgaatttcactgggcttccccgagtctaagcctataaatatctgttagtctatatgtgtgcattctcaggctgggtagaggccttccctactagcacagaaaaggcacatgaagtggcccaatttctcctaaaggaaatcattccctgacttgggataccaatcaccattggattggacaacagaccagtgtttatagctgaggtggtgcaattggtggcaaaggggttgaagatcacctggaagttacacatggcccatcagccctaaagctctgagaaggtggaacagatgaatcggactctgaaactgcaattaagcaaactgtgccaggagactcaattacattgggactagctcttgccagtagccctgctgataattcagtccagccccactaagcagacagagtttttcccttatgaaatcctctgtgggcatccccctcctctcattaagagtataagggggcacccaaaagaattaggaaacctcgccgtgaggcaacagatacaggtgtaggttccactctggccaccctcaatcagtgggttagggaatggttacctataagcctaaccacagacacccaccacttcaaaccaggggatgctatagagataaaagaatggaatatccagccattaagtcctctttgaaggggcctgtttactgtcattttatccacccctactgcagtaaaggtggcagaattggctccttagattcaccacagcaaaataaaaccagcatcttgagactgggagtgcatccctgatccctcaacactgtacaagctgaccatccaaaagaagcaagttgcagctccagagacccctgaggactatagccttgctctagtcactcagaagttgactggtctacacatggcagaaacttgaggaatcagccaccagatgggataaatagactgtttttgtttcccatttcagtcctcttactgtgatgcactgccaccccttgcgcctgtctgttgttatgatccttcccctgacctttgccatgggattggcagagactgctccatctgactgaaaatgtgacaaaagacctggcacaaggtcaacgcagacattgaatggtgggccccaggtggactatactggatatgtgggagaacagcctatactgtacttcccccagactggtcaggatcttatgtgttcagatcaatccacccacctttcttcttgctcccactttccagcaggaaacatttgggagtccaagtgagaggaccaggatacctaaagaaaactgcgtgaactacaaattgacaactgaaaagatgacaaatggccccctgagcgtatgtccattactatggtccagccacctgggcagaggatgggtcttatggatactgtactcccatctatataataaactacatcataaggttacaggcagttgttaaaaatttctttggggaatggttttcaacttttgggagactcaaaaccctcatagtttttaatttggggggcttgcctgatccttccctgcctagcccttctggttatgaggtctgtttccagactcattgaggccatggttaaaaaaaaaaaaagccacatgtcatgattctatggaaatataaacccctaaaccaagatgatgctctttgaccccaaagggaggttcatgcatcaaagggggaaatgtggtaggggtccaccctgaacaaagggaaggcaaagtgcacaatcagcatctgtgtgcacatgtgcaactttgtggcagtatgacataatccatattcatgtgcaactttgtaacatagaccatccaaccagaatttacagaatgtatgttaccttataaggggacaaagggacataagtgtaaaagaaaaaaaaaaaaaaaacaacagtgtatgtaagacagtgccccgctgcgtttggagcttagcctttggatatgaatctactgagccagtgccggcacgaataaatgctgctttctggcaagaaacctcagtgtcctgcctccctatatga

SEQ ID NO: 185 - DNA, 6645 bp, artificial
  ss1623 sequence
cttcctcctcctccaccttctcctccttctctctttccctttcttttcatttcttttctttctttccctgatgatccccttcgcccatttctctcatcacccatctctagcaaacaccaatctgttctctgtatatatgagcctgtttctgggggggttgcttagattccacatacaagagaaatcatatgatatttgtgtttgtctgatttattcacctagcataattctctcaagatccatccatgttgttgcaaatggcaagaattcattgtttttcatggctgaattatagatatagatatagatacacacaaaagttgttttcctatcttggctattataaataattctgcaatgaacatatatttgttcaagttagcattatcatttcattcatagaaatacctagaagtagaatagatactaggtatcatatggttattaaatttttaatttttttacaaacctccatacagtttttcatagtacctgtaccaatttgaattcccaccaatggtgcattttttgataaaagaaattagaaaaaaatatgaaagttagttttacagaaatatgtgatgcaaaatactagatcaaaatagtatttttatgaagtttctcacataaaaagtaacccccttttgtctttcctcctacatcccctgctgggcttcatttcttcctaaaatatgtgtgtgattaatttaaaaaatgacctcaaattgagggatctagcatcttcttttcctagttctttcatatataagactaatcaaaaaatcaacttttatcctcaaggaaatgatccagggtgttgccctgctgaaattttctaagacttcaatacaatagcaaatatgttaaaacccctcatcaagtaaataaccatacaggaaatatttgataacaaaaatcaatgcttctaaactttcaccgcacatcatacatcatacatacacacacaatcaggaaaacttcaggtaaaatatcttcatgtcctctttttttttttttttttgtcttttttttgccatttcttgggcctctcccgtggcatatggaggttcccaggctaggtgtccaatcagagctgtagctgccactggcctacaccagagccacagcaatgcaggatccgagctgcatctgcgacctacaccacagctcatggcaatgacagatccttaacccactgagccagggattgaacctgcaacctcatggttcctagtcgttaaccactgtaccactatgggaactccttcatgtcctcttttaatgacagatatatagtaaagtcagaaaacaaaagttataaaaatcatactgatttcatagtttatttattacatacaaatatttgaaattctctttagtaacatactgttaaaaaagaaatatatatatattttaaagtttttgttgttgttatttccccaatacaattttttttttttctactgaacaggtacacatacatgtatacatccttttttctcccattatcatgctccatcataagtgactagacatagttctcagtgctacacagtaggatctcattgctaatctgatccaaaggcaatagtctgcatctattaaccccaggctccctaaccaccccactccctccccctcccctttggcaaccacaagtttattctccaagtccatgattttattttctgtggaaagtctcatttgtgccatctattagattccagatatgtgccccatcaaccaagtagctttccctattcagaacaagagccaaactccctgggactatgctctgcacaagcattcaacatcacagtagatctccctagtttacaggatttaattctccttcctagtgaatctcctacctctattacaactaaactggaaaaaacattaccaacagatacagtaggattgataataggaaggggagggctaacagaacaaggagttagagttcataacgggatattggataatacaggggatgataaagtacaagtgatggtttccactgcaactccttggaaaattaaaaaaggggattggattgctcaaatcttaattttacctagagtccagaagaaaaaagagaggaataattttagacagaagggattcaataccacaggaggggcaggagtatttttatcagaaaagttcctagaggaatgacccacttgccaagttatcataaatgggaagtcttttagaggattgattgatactggggctgatgtttcaatcattagccatttacattggccagacacctggcctcttcagccagctgatactgaagccactgggttaggaaaagcaaagggtctcaaaaagagtgcccaatggcttaattgtgaaggaccagatgggcagccagctagattgaaaccttatattgctcaactccctatcaatctatgggggagagatttgttacaacaatggcatgcagaaacttacttaccaccagtggatcaatatagtcatcaaagccaaaaaatgttacagaaacagggatacaaacctatcgaatctgagattaaaatggacaaatctggtttgggatattggccttttcattagcagccactgcttgtaaaaataattatgcttctcctaaacctacttgattaaaatggaagacagaagaaccagtttgggttgagcagtggcctctttcttcagaaaataagtgatcttgtccaagaacaattagagaagggccatatagaagaatcctttagtccttggaattcaccagtgttattcaggaaaatggagattgttaacagatttaagactagtaaatgctgtaattcagcctatgggtaccctgcaaccaggcctcccatctcctagtatgataccagctggttgttaattatcctggacttacaagactgctttttcacaattcctttacacccagaagataaggaaaaatttgccttttcagtgccagtggtaaacaatatggtcccaagaaagcattatcaatggaaggttctgcctcaagatatgttaaacagccctaccttgtgtcagtattatgtggtttcagttgttgatccagtcctaagacaatttcctaaatgctatattgttcattatatggatgatatactttgtgctgcaccctctctggagcagctgactgaggtttttcaatgcttgcaatcctgtctaaaaggagcaggattgattattgctcctgaaaagattcaaatgaaaagtccatatcaatatctgggaactgtggttgaatgtaccactgttcaccctcaaaaggtagaactgagaagagatcaaatttctacattaaatgacttacaaaaactattaggagacattaattggctctgaccttatttcgggattcctacatatgaattgtcaaatcttttctccttacttaggggagattctaaattaaacagccgccaatctttaactgcaaaagcagaagagaaactaaaaaagattgaaagtaaaatacaaaactcccaactaagtcgggtcaatctaaaacagcccattcagttagtaattatattcatgtatgtattgacacttactctaaatttatttgggctactgcacaatctggtgaatctgctaaacatgttattcttcatttatatgactgttttgcagtcatgggcctgccacaagcaattaaaactgataatggtccagcttatatcagttctcaacttaaaacattcctggatacatggcatattgctcattctactagtctcccttacaacccctaaggacaggctactgtggaatgagccaatttatatgtaaaacaggctcttcaaaaacaaaaagggggagacacagaaatagttaagtcacaacaaacacttttaaacaaaaccttattcactttaaattttttaaatttggcctctgacgagaaaaaaaaacaaaaaaacaaaaaaaacaaaaaacggctgcagagaattttaatacagaacaaaaaataagattaactttcctcatgctgaacagcccttgatttggtggcaggatccattaacaaacttctggtctccaggaaaacttatcatgtagggcagaggatatgcttgtatttcaccaggtcatagattacaacctgtttgtactccatcaagaagaatcaaaccatatcatgagcaagcccatgaagcatccctcaactccagaccccagaaggatgataacggctcatcttcccacttgggaagatcaaacatctaacctgagaagctgaaaaatctactaagaagagaaggaaagcctctcactccaaataatttggtatagtacagggattaaaagcctcatgagtaaagcccattaaaaactattggaggtttactaggggaacaagagagtccatcagctttcttagaaagactcagaaaggcattgagaaaatatataaaggaacccagaaacaatggagggccgaataattattaaggataaattcataactcaatcggtgccagatatatggagaaagctccaaaaattggcttttagccctgatcaggacctggagcacctcctcagagtagcaactcaagtatgttataatcagggccaggaagaatgaaaggagaacaagaagagagacagaaaaggttgaaactctagttatggcactacagggagtcaacctgggagtttccaaggtgagaggactagggcagagacctatgcccagagcctgtttcctctgtggaaaagagggaccctttaaatgggaatgccccaagactcagagatcactgaaagaggggccatccctgaagacgaaggtctctgtggttgatccctcaggcccaggatcaagactgatgggacatttccataatggctcctgtccttatcaccactcaggagccctgggtgactctaaatgtaggaatactgagccacttttcagtcctcctctccaatcctgggcccctccctcatgaatctaccacactcatgattctggcaagccggttacaaaattctttatacaacctttgagttgtgactgggaatccattttcttttctcaatacctttctgattgtttgagtccaactcctcttttagaaagagattttgtgagaggttaaagcctcaatgcacatgcaaatggagtctaatcaaggtttatatctgcctttaatggactagatttaaaagatgcctttattctgcatttccttgactaaggctttgcatatacaaattcttaaagtatggaaggtaactacatacatgttgttgcagctgacaacattaggtatagtaccttatcatacctaggtttaacagaagtcaaattagacactgaaacatcagttactaaacagaaactaaaggtatttagaatgattaatcaatatgatcagtgccaccctgagatggtttctataagaaaaacatgtgtttttagaaattataaagaacagtccgtggttgctttagaaaagtagaatgtgtgtgtttccaatatagaaggaatgaggaatggaattgcatcttattaaggcaaaagaaagattgtcttcagctgattgctctggttggaaaataagggacagactaatatggatacagaaagtgatacaaggtgtgtggcaagtggacattgagaagagaattttgagcatggtggggactgtttagaatatatttgagtaagttaactttaaaaataaggtaatgcaataaatcatactgttcaaaaggacataaggtagctttcaattacatgccaaccaaggcatacaaatgtttcataaccagccagagaaataacaaaaatcatatgttacctgtgctgttataaaatctaaatgttgtattcctgattgttcacagaatgtgtctaattccctgctagatcttcatcagtagattcatgagctgtccaatccagctccagcttttggagctgccctgtggaaccagctgacctcctcttcctggtgaaaatatttctttgaggtatccaaagcaatgtatcaaagcccacttgaccgttccatgagtggagacctaactgctttccctaacgatgccccttttcagcaggaagaagttagagtggtcgtcgccccttttcccacagatagtctccaactcaaatggggtaattaaggcagaatattaactcaggtagtcagtgtagggatatgggctttgagacattctttgatgtggtcattgattaccatttgtaaactgagggtcgcacagcaagcccaactgctataaaggttataggtattgtcccatggatccatcacatcagagtcaagaaggctgcatctgctgctgacatggacaccagagaggctgtacagcatctcgagaattccttcatggtcaagttccagagactccctttaccatcctcagagagtgctaagccctgcactggccacccctggaagctggtcagtctacgcatgccagaaacccaaggagttccacatgagacttaacttggactctgagacttaacttggactgtgttctgtctatatatgttagaagcaagtaatccaagaagaaatgaaaaaagttgcaagacctatttttgtcttcccacaaaaaaaaaaaagggggagatgt

SEQ ID NO: 186 - DNA, 6964 bp, artificial
  ss1548 sequence
tgttgtgagacatgtttccctaatcttcttccttgattgttgagagacatgtttctctaattttccttgattatctaccaatagcccctcctcacatgatctcatttaagaaacagaataaaagctgtgtggtttctggagacaaggctcttggtccctgtgaccttgattcccccgggttctcacctttactctctctctctctctctgtgtcttgatatttttgtcttgttgttttgttatttttttcttaagttctatagcacccgttcttcagccccatcctgctgagctggcttcagcaagtggcacccaacatggggcgggcaaacaggcaggcacgaggaatgaagggccgtgactacagtggtattttgtggaagtgctatggagccctgaggagaagggaggaattttgcgtggccacactcaaaaaaaaaaaaaaaaaaatcctgtggataagttccctctctcaggtatttacggggttaaatgggaaataaggtaattgcaggaaaccataattcttatatttgtttgttaagacaactccttgaagggggcataaaaataagtgaaaacaagctctcagaactttttaagacttgagaaacactgtgattggtttcttaccttagaaacgttaggtttaaaaatatgggaaaacataggaatggaacattgtatgataagggtgtttcaattcctgtgtctatttggaatacttggagcttaatcaaatcagttttagaacctctacggacttcagggaagttagaggaggaagaagaaggggagtttgcgcctttgttggaggaacctaaatatgtagtccctgaacaaaattaccatagagaatctttggctcctgagcccttggctccaattttggatactgatattcctcaaatgcctcatattaggagtaaagtgatgaggactcatcaagcctctacttctagggttgcaaaggaaatgagtgtcatccctgaacaccatctatcatctattcaacagggaattttacaggcttgaagggaaggcaatttggatgccatacatttagcctttctagtaactgtcagggagacaatggctccaggcattgatcctgccaatcctgatggagtttatgagttcattcttgagccctttgcttttaaaattcttaaagaattaaaacaggctgttcaaaactatggtgttaattctccttttacaaaaagaatcatgcagggagtagctgaaggaaactgtctgattcctgttgatggatacagcttaacccgtgctgtgctatcgcctagggaatacttgcaatttaagtcttggtgtcaagatcatgcccaaattgctgctaatcataatcaggcttgaaatcttccgattacaatggaacaattattagggattggtccttggattaatcttcaggatcaagtgaagatgaatgatttggccattgaacaaatcaaacaatgttgcttaacagcatgggataaaattgaatctaagggccaaataaatacttcttttcaaaagatcctacaaggtcctaaggaaccttatactgaatttttagctcatttacaagaggcgttaaaacggcaagttactaattttgaggtgtctgctactatttttcaattattagatatgaaaatgtgaatactgattgtaaaaaggccataggatttttaaagggaaaggctaacattgctgaatgtattagagcctgtcagggtgtggggatggtgtcctttaaggccccaatgctagctcaagcaatggctaatttaaaagacaagtttttagaaaaatgttttaattgtggcaagacaggacatactaaaaaacaatgttgtgctcctccacgagcccgaccttcctttcatggagttttggcaccttctagttagaataataaacagcccagactatgcccaagatgtaataaagaatatcactgggctaatcagtgccggtccatctttcataaagatagaacccccttgtcgggaaactccttggggcaagcttccagccccatcaaccaaggaagctttccctattcagaacaaaagccaaactctcaactgagcgagagcccctgggactacattctgtacaagcgtttaacatcacagtagatcttcttagtttacaggatttaattctacatcccagtgaaactcctatttctattacaactaaattagaaaaaccattaccaactgatacggtaggattgataatagaaagggcagggctaacagaacaaggagtttatgttcatactggtatattggataatatagggaatgataaagtacaggtaatggtttccactacaatcccttggaaggttaaaaaaagggattagattgctcaaatcttaattttacctagagtacagaagaaaaaagacaggaataattctagacagaagggatttgataccacaagaggggcaggagtgttcttatcagaaaaggtcctagaggaatgacccacttgtcaagttatcgtaaatgggaaatcttttagaggactaattgatactggggttgatgtttcaatcattagccatttacaatggccagacacctggcctcttcagccagctgatattgaagtcactgggttaggaaaagcaggtctcaaaaggagtgtccaatggcttaattgtgaaggaccggatgggcagctagctaaaatgaaaacttatgttgctcaactccctattaatctatgggggagagatttattacaatggcatgcagaaatttacttaccaccagtagatcaatatagtcatcaaagctaaaaaatgttacagaaatagggctacaaacctgttgaatctgagattaaagtggaaaaatctggtgtgggacagggaccttttcattaatggccactgcttgtaaaaaccattatacttctcctcaacctattcgattaaaatggactatggaaaaaccagtttgggttgagcagtggcctctttcttaagaaaaaagttttaagcagtcttgtccaagaacaattagagaagggccatatgaaagaatcttttagtccttggaattcgccagtgtttgttatacagaaaaaaccaggaagatggagattgttaacagatttaagaggagtaaatgctgtaattcagcctatgggtgcccttcaaccaggctttccatctcctagtatgataccagcagactagctgtgaatcatactggatttaaaagactgttttttcacaattcctttacacccagaagatagggaaaattttgccttttcagtcccagtgataaacaatatagcccctagaaaatgttatcaatggaaggtcctgcctcaaggtatgttaaacagccctaccttgtgtctgtcaacaggctgaattaactaactgctgtgatccatgtcttgagggactatccttagccaataaatattctttctgactcagcatatgtagttcatgctgccaaaatgattgaaactgctaactgctaccattaaacaaaatttacctatctcgttattagatctgtttacagaattacaaactgttgtaagggaaagaagatattcattttatatcactcatatcagagcacatactaacttaccgggacctctatttgaaggtaataaagaaattgattgcctggtaacacctgtgttacagaagctcaacatttttcatgatttaaaacacatgtaaatgtccgaggccttaaagagagatttggaataacatgggctaaagctaagacaatagtccatcaatgtcctgcatgtcaaactattaacaatccttctcaatccgagcctggagttaaccctaggggacttgtcccaaatgctctctggcaaatggatgttattcattattcatcttttgggaaattatcatttattcatgtatgtattgacacttgctctaaatttatttgagctactgctcaatctggtgaatctgctaaacacattatttattcatcatttgtatgcctgttttgcagtcatgggcctgccacaaacaattaaaactgataatggtccagctatatcagtactcaaaacattcctggatacatggcatattgctcactccactggtctcccttaacaacccccaaggacaggctattgtggaacgagccaatttatatataaaacaggctcttcaaaaacacaaagggtgacacagaaatagttaagtcacaacagacatttttgaataaaaccttattcactttaaattttttaaatttggcccctgatgaaaaaacagctgcagagagacattttaatacggaacaaaaaaagattaacttccctcaggctgaacagaccttgatttggtggcaggatccattaacaaacttctggtcccctggaaaacttattatgtggggtaggggatatgcttgtatttcaccaggtcgtggattataacctgtttggattccatcaagaagaatcaaaccatatcatgagtgagcctgcggagcatccctcaactccagaccaaaaggacaatgataagggctcatcttcccacttgaggtcagatcaaacatctaaccagaaaggctgaaaatctattaagaggagaagaactcagaaaggcattgggaaaacataaaccaaggaacccagaaactatgaagggccaaataatgttaaggataaattcatagcttaatcagtgccagatatatggagaaagctccaaaaaattggcttttggccctgatcaggacctgaagcacctccccagaatagcaactcaaatatgttataatcagggccaggaagaatgaaaggagaagaagagagagaaaaggctgagactccagtcatggcgctaaatgagtcaacctgggagttcccaaggtgcaagggctaaggcagagacctatgcctggagcctgtttcctagagatcactggaagagggactgcccctgaagaggaaggtctctgtggtcgacccctcaggtcccatgatcaagactgatgggacatttccataatggctcctgtcattatcaccattcaggagccctgggtgactctaaatgtaggaagacagcctatgactttcatctaaatacaggagccactttcagtcctcctctccaatcctgggcccttcttcataaatctaccacattcttatttctggcaagccgattacaaaatttttttacacaacctttgagttgtgactgggaatctgttttcttctctcaatgcctttctgattgttccagggagttcaactcttcttttggaaagaaatattttgtgggaggttggagcctcaatttatatgccaatggagcttaatcaagatttatatctgccttcaatggactagatttaaagatgcctttatttctgcatttccttgactaaggccttgctgttataaaatttaaatgttgtattataaaatcaatgttgtgctagatcttcaacagcagattcatgagctgtcctattcagctccagcttttggagctgctctgtggaaccagctgacctcttcctcctggtgaaaatatttattcaccatattcattgtgatcttgatccttttgttcagaccctgtataattaattgtacttcttgcttcattacatcctgactaagctatcaatgttcaaatgttaatgaaagaggtattcgaggcaatgtatcaaagcccacttgaccattccatgagtggagacctaactgctttccccaatgacaccccctttcagcaggaagtagtcggagcagtcatcgccccttttccccacagttagtctccaactcagggaggaattaaggcagaatattaatagtataggaatatgggctttgcatcttttgactattaaagtttgcagattaagggtcgcataggaaccccaattactataaaggttgcagttgttgccccatggaaccgtcctctgctactacatcgtggtccagaagtctgcatccgcggctggcatgcatgcctgggaggctatatagcaccttgagaatcttctcatggtcaagttctaaaaactccctttgtcatcatcagagagtgctaagccttggtctggccatccctggaaactggtcagtctaagcacggctaaagcctgaagagttccacgtaagacttaacttggactcatgttctatctacggatgtatgaggccagcgatttaagaaaaaagttgcgagatttatttttgtcctcctgcaaaagcaaaaagggggagatgctgtgagacatgttgccctaatcttccttgattgttgagagacatgtttctctaattttccttgattatctaccagtagcccctcctcacatgatctcatttaagaaacacaataaaaactgtggtttctggaggcggagctcttggtccctgagatcttgagtcccccgggttcccacctttactctctcctctctctgtcttgatatttttgtcttgttgttttgttatttttttccttaagttctgtagcacccgttcttcagccccatcctgctgagctggccttggcagtggtgtagtttgcagatgtagctcagatctggcattgctgtggctctgaccagtagctgcagctgcaatttgacccctagcctgggaacttccatatgccacaaatgcagccctaaaaaaacaaaaaaagcaaaaaacaaacagacaaaacaaaacaaaaaacatagagaacttccattttaaagaaaacatgtaaacacctacatgttcacacaaaaagtgtgggaattagcccccaaatttaaaagttctcactaggtggcaaaattataagtgatttttctttttcatccttttcttttttaaaagtatctgatgttttgacactttcaacacaggacctgcaatagcttagaaagaagggaagaaatgt

SEQ ID NO: 187 - DNA, 8735 bp, artificial
  ss1553 sequence
tgctcggtttcttagggaggaacactgtctgctcggggatgaggggaggtccgggatgcttacatgggagaatcaagaccttgtagtgtataaaagttactgagaacaaagacctggtgctcagactctggaggtgactcctctgagcccgcactggtgctgaataaaccttgcttttccatatctccgagtgctgtttgtctccttccattgccacagtttttgtggtttccgcaacatttttggtgcgttggctgggaagccgacaaccgagctggcctcttgtgcaaccgttgtcagggaaccgggggaggccacggttgccggccccgtgacaggtggatagcatgcagcggccatttttccagatccagaccctcactcggaccgtgctggccttggcccacaccgcttcccgaacggactcagaaggagagtggaaacaggttcctggacaggactcggactggtgagtccccggggacatctacccaagtcaggacccgccatacggtggaaggagagactgatcacctctcagtgaccaaagggtcactcaggtcagggtttggtcccttgggatcgggaggtttgtcagttctggggtgtgtgtgtgtgtgtgtgtgtgtgtgtgtgtgtgtgagagagagagagagagagagagagagagagagagagagagagagagagagagagagagagagactggagagaatgagagcccgtgctccaccgtctttggactacggagccagagtgagtcctaacctgcagttccgtggcgaccctcatatggcttatggtggccctcttcggggggatcctgacattggggtttatacagtcccacctatgctaagaggcgcctgaaatatctcctccgggggagcggtcagacagacgaagcgattgttacctgaggccttgtcctcagtgtttgtcttgcgtcaccggcacagggtgggacttcacacaattcggcttccaagcccactgtcttagagtatatggttaagaattttaagaaaggattttctagagattatggtgttaaactgagtcttggaaaactgtgtaccctctgtaccctagagtggccctcctttggtgttggctggcctccggaagggaccttagatgtgttcacagttacagcagtatataatgttataacaggagaccctggacatccagaccaatttctgtatattgatcaatggttggaaattgcctatttgaggcccccatgggttcagttctgcaccacagaccagggacagtgtagggtgctagaagcccagtccaagaagaaaaccttgtctcaaaaaaaaggtgccacctatttatcaaggggaacctgaggactcgccccctatgccaccaccttatgtgctgccggccccacctccaggagccgaaggtccccaggtgcaagatagcccaccgccttctgtttctcctcctccttctgcttctgaagttcccgaggcgatatcacccccgcagccagattctccagaacctatgagcaggcgtctccagtcagctcagggagcagccactccagcattgcaaatgcccttacgggagacacggggaccacagcaagtcgcccccgaagggaccatacaagaggggggacgtttttattattaccagcccttttccactgctgatctcctcaactggaaacaccatactccctcatattctgaaaagcctcaggcgctgattgatatcttagaattcattttccagaaacactgtcccacctggatagactgctggcaactcctttttactctgacactaaagagcgctggcaaattgtaacagaagcccaaaaatggcttcaggccaatgcagggagtcgagcagacttggcaaactgggtgagggaagtcttcccagaagaaaacccccactgggactatgacactgaagaaggggaacgtaacccagagaggtaccgacaggccttcctacagggggcaaaagctggggctaaaaggcccactaatatagctaagatcagtgagatactacaagagccaaatgaaagcccagccaaattctatgagagactatgtgaggctttccgaacctacaccccttttgatcccgaggcccctgagaaccaacggatgataaatgctgcctttgtgggacaagcccaatcagatatccgtaaaaagctacagaaattagaaggatttgcaggagagaatgccactaaactattggaagtagccaacaaggtttttattaactgagaccaggtggcccgccatgatgcagaaaagagaatgaaacaaaaagtgactcttatggcagctgccctgtcaaaaccggtgcccccagtgggaccttcccataggggacaaggcacaaggccagggaaaaggagtcccctggaacatgaccaatgcgcttactgcaaagaaaagggacattggaaaaatgaatgccccaaccgtcctgagaaaaagaccaaggcctcacctagccagtactgatctgagccattcagcaccaacctgatccgcctagctgagtctgattagtggggaccaagctctctccaactgggcccccaagagcctatggtcagaattcaagtagggggccaccccatagactttatggttgacacaggtgccgaactttctgtggttacacaacctgtggctcccctctcggggaaagaaaccaccattgttggggccacaggtaaccaaacccacagacccttctgcggtcctcgacgatgtcggttaggaggccatgaaataatacatgaatttctttacctgcctgactgcccagttcccctgatgggaagagacctgctggctaaaatgggggcacaaatttccttttctactgacagatcagcccaaattaaattgacagaaccccccccccctcctttaatcatggctcttgctgttaaaagggaagaggaatggcgcttgtactcttccccttcagaaatggggaccattcccccagaactagagactaaatacccattggtttgggctgaaggaaacccaccaggactggcaaaatgccacgctcctgtcttggttgatctaaaacccagagctcaaccggtaaagctacggcaatactcgattcccagagaagctcgactgggaatccaggttcacctggataggctgcttcagcatggactgttaataaaatgtcagtccccttggaacacccctttactgcccgtgaaaaaaatgggaacacgggactaccgcccagtacaggacttgagagccataaatgaagcaacagtcacataacacccatccatccctaacccgtataccctgctagggctgatcccctccactgctgagtggtttacttgcctggacttaaaagatgcctttttctgcctctgcgtggcacctgccagtcagcccttgtttgcttttgaatgggaaaatccacatacagggacaaaggaacagctcacctggactagactcccacaaggattcaaaaactctcctactctttttagcggcaccctagccgctgacctggctgaatttcctggacaaaaactgggctgtgttttgctacagtatgttgacgacctcttactggctggcaccacggaggctcagtgcctagaaggaacaagagctctcctttccctactgatggaggcagggtatcaggtatcaaagaaaaaggcacaaatctgcaaaaaacaagtcaagtatctgggcttcaacatcatgcagggccgacgaatgctggggactgaaagaaagcaggcagtttgtgccattcctgtccctaccacctgccagaaggttcgtgagttcctaggggcagcaggattctgccggatatggatccccgggttttcagacttggccaggcctcagtatgaggctctaaaaggagaataaaaaaggctccccttgaatggggaccaagccaggaggcagcatttcagacaatcaaaaccaaactcactgaggctccagccttgggacttcctgatgtaaccagagaatgtaacctttttgttcatgagaaaaatgggatggctatgggagtcttaactcaaaaatttgggccttggcagaggccagtggcatatctgtctaaacaaattgactcagttgcagccggatggcttccctgcctcctagcactggcagctaccaccttgttggtgagagaggctgacaagttgaccctgggacaaaacctcaatgttaaagtcccgcactcagttgtaaccctaatggatacaaggggccaccattggctcacacatgcacgaatgactcaatatcaagggttactatgtgaaagtccacgggtaaaactggaggttgtatgaacccagccacttttctgccagatggagtggggcccccagaccattactgcctggaggtactagatgaggtgttttcccgcaggcctgacttgactgataaaccactccaaaatcctgacctggttttatatactgatggctgcagctttttggaggatggaaaaaggatgataggatatgctgtggtatctgacttaaaagtgatagaagcagaggtgcttcctcaaggctggtcagcaccgagagcagaattataggccctaatcagagcactggaactcagttgagaccagcgagttaatatctataccgactcacaatatgcctttgcaactttacatgtccatggagccttatataaagaaagagggctcctcactgctgaaggaaaaggaattaaaaaccaggctgaaatcttaaagctcctagaggcagtatgggaacctaaagaagttgcagttatccactgtaaaggccaccaaaagggagatgacccagtgacaaaaggaaaccgtagtgctgatgcagctgccagacaggcagcccagggacatcagccagacaaacctaaggtcttgctggccccagaagtgccagctatccccagatgttctccagaggaagaaaaatggataagggaggaagcaggaactaaaactaaaatgggatggtgggtcacacgggaccaccgagtttacgttccagaacagctggcctacagactagtccaccaccaacatgagctaacccacatgggcaaaactgccttagagaccctactgggctggtactatctcattgctcatcttcctgcactctgctcctctgtctcccaaagatgcataacctgtttacagaataatgcccgcgaggggccccacagaccagctggggcacaacactgtggattgcccccattttaggatataaaagtggacttcactgaggtcacccctagtgaggggtacaaatatttactagtttttatctgtactttttcaggatgggcaaaagccttccctacccaaactgaaaaggcaagggaagtaaccaaggcactcctgagagacattattcccagatatgggatgcctctgaccattgggtcaaataacggactggcgtttgtggctgaaacagtacaacaggtggcaaaagctttacagatccaatggaaactacattctgcttattgccctcaaagttcagggaaagtagaatgcatgaaccgaacccttaaacagacactggcaaagttatgtcaggaaactggcttgccctggatagacatgttgccggtggccctcctaaaagtgagatgctcaccctgagcaggaataggattcttgccatttgaaatctgatatgagaggccacctccacgaatcagtttaaaaggaaacaccaaagagttgggagacttggaattacataaacaattacaaggactggggctcactatttctcagatacataaatgggtcacagacagaatacctgtgtccttaggtataacagtacacccccacaagccgggggaccaggtgtggaaaaaggactggaaaaaggagcctttgaggccggtatggaagggcccctatactgtaattctaaccacgcccactgctcttaaagtaacaggaatagatgcttgaatccatcattctagagttaaactgtctggcccagctgacgaccgtggagagtgggagactgccctcgatccggagagacctctttgcctgacaatacagagaaggagatgacgatctcaaagccctgctctgaccacactggaagctggtcagtcaacgcacggctgaagcttgaggaatcggctgcctggtaaaataaactgccttacctcccttccacaagagactttcttactgttataaactgttgtcttatgaccaacatgaatgtttgctgcctgttgctgttaatctggtcccctttggttctgccaggatccgtttcctcatgtgacccatgcatttgagtgacccgatcagatcaaggggttacatggactttgctttactccactcatttctcctgttgtggagaaattcatggaagttgtactcacaacaggaccacttattctgtcaacagggggaccaatatacttgctttgatccacgatactcaccaactgaggaatggttagaagtccagcgctctcataaatcagggcagctaattaatcggacccaaattaccaacaccaatttgccagtatcaatattttttgatgcctgtgaagctatgaatgggtcatggacttctactagaccatgtggaagcccatcatgggaaagaaaatataggctccagcataaatatatgtgctgggggaccacctggagcggttgccagaaatgcacttactggagctgcgtggcctgggcaacctaaaataaaggagacaaaacagctctccttcaaaaaggtacagcccctccagactgtcagactaaagcttgtaacccagttaatttcactattttcaattccagtgagcccaaatggaaggagggtttcaaaataagcattcgcattgatggaagaggccttgaccctggagctgtgctacatttccagagaatcacgtttgcgctccaagctgcctctcacagcatctttcattccttttatgaagagataagaaacaccccacctcccattctggccacaactaagaacttgttcttagccctggcagaaactattgcacaaactctcaaggtctccacttgttatgtatgcgggggaacgaacacaggagaccactggccttggcaagccagagaactgaacccattagagcctcataatgagactgcatacccccagctcaccaatggggtatggctcctcagaactgctattatagggagaaattgtctggtgaggcggggaggatggtttaatgtttcagttggaagcctaacatgtttaaggcctaaggtattataatctgactgcccaaaggactcaatggtggccatcctccaatctctcagagcccaagcctaatcccctgtctaacttttcccacctctgacgagcatgggaagatatcagtgctaatatccagtagcaggcaccaaaggggttatattggatttgtgggaaaatggcctattccatactccccccgaattgggctggggcatgtgtactgagaacaatcagaccttccttcttcctgctcccgctgtcactaggggagcaaccgggagttcctatatatagggcacagggtgcccagagaaactggagggctctccaaattggagactggaaagatgatgaatggcccccagaacagataattcaatattatgggccttccacctgggcagaggatggctcttggggatatcgcacccctatctatatgctgaaccatatcatcagactacaggcagttttggaacttataacaaatgacactgcaagggccttgactatattggcccaacaacaaactaaaatgcacagtgcattctaccaaaatcgcttggccttggattatttacttgcttctgaaggagggggtttgtggaaaatttaacttaagtaattgctgtctacaaatagatgacaccgaaaaggtggtaaaggaaattgctgaccgcatgactaaacttgcccatgtacctgtacaaacttggaaaggatgggatgcagacagtctctttggtaaatggttctcttggttgggagaaagtaagacaatggtcggaataaccatggttatactcacaggttgcctacttattccctgccttgtacctctcctgataaatattataaaaggttttataaaaaccatggttgaaaaaaaaacggcctcccacctgctacttatcagaggctaccaaaggattatgactgatgatgatttctaaagggtgcagatgcaccctgaacaccaagaggggggaatgaaatagagttttaactaaagaacaaccccccttggctaagaaggcagctgcaagcctttccagctatgcttatcactataccacccttcttgtaataacgtaacaactgtgtgccctatgtccaagccagcagccctgctaatcaggtacccaacattgcttatcagttccgcttctgtaaccttgcttgctcggtttcttagggaggaacactgtctgctcggggatggggggaggtccgggatgcttacatgggagaatcaagaccttgtagtgtataaaagttactgagaacaaagacctggtgctcagactctggaggtgactcctctgagcccgcactggtgctgaataaaccttgcttttccatatctccgagtgctgtttgtctccttcca

SEQ ID NO: 188 - DNA, 4454 bp, artificial
  ss1567 sequence
  misc_feature (2018)..(2117): n is a, c, g, or t
agccttgttccaaaggtgctaaggcactgtggaggggatgcattctcataatcttatttaactaaatcgaggcctgagtccctaggctaccaccttcaacttcaacgtgcttcttagtcctcccccccaccctgtacatgaactaggaagcctagagggggctggagttgtctaagtgcccatctccaggttatatgaggctctggtagtttccaagggcacacctttgttaaggagaacacaaaatgattgctgtttcctccccctgacaaaacatgaggggatttgcctccagtctgcactgtgaggatagggagggggagaggggaggtttctggaagtaaaacccatgaaagtttgaggcctcctcgaagtgggcccccaagggtaactctcaagccagtctacgttcaacctccagcgatccaccaacaaccatttaggtgttcctaccaaatacagcctctagaggattctgtttctgtaagcagatctcaactctgattttctgtattcaactctttcttgagtcttcagtgtggctgttcatcttatgaccttaattatctgatggaccttttaagtcactggtttccagtctgttcagcttttttcttgtagtaaggagaactgtgaggaattccaagctgttgatgtcagagttgaaaacggacgtgttgattttttttaaatcagtaaacataaacccacagaaacaaaagctctttggagtaggcaacatcttaaaagggtaaagggtcctatgatcaaagtgtgtgagaactactgtgctatatataaattatgattaggtggttatgtaattcccactataaataaactgctctttaaaataagcaagtcaataaatcacactgtgatactggtggaaaggttacaaaaatattcttttttatttcaagtaaaaaaaaaagagaacacttacaattcatgacaagagtaatatggtacactaaaattctcaaaaaaaacttctattcctacccctatcaattccatacaaaaaaaaaaaaaaaaaaaaaacccttattcacaaaacctctaccaagtgtaaaataattcataatttcagtaattgtactgaaaacacagatgtgagaattattttataaagtcccaaaccacgggaaaggagttcccatcgtggctcagcagaaacgaatctgactaggatccttgaggatgcaggattgatccctggcctcactcagtggcttaagtatctggcactgctgtgagctgtggtatagcagcagacacagctcagatctgccattgttgtggctgtggcgtaggccagtggctacagctccgattcgacccctagcctgggaacctccataggccccaagtgcggccgtaaaaagccaaaaacaaaacaaaacaaaaacaaacaaacaaaaaaacaaaaccacacacaggagaattatattacctaaaaaagtgtagctcagaggaattagtgattaaaacttcagcacagtgaacttgctttcgaatgataaacagaattttctctgctatccaaaataaaaagcattgtagacagagggaaaagcacatgcaaaggtagaggagcctaggaggcaggcaggagtaagagtacaaaagactttgtatgccatgctaatgcgtaaaggtgattcagtcaggagcagcaaatgctagaaggatcagagggcaattcggaggatgaaatggaggtaaagaaaacgaaggctaaagaccagtaaatactagaattatttgggtgtgaagacaaaaggtagagataatgaaaaagagtaaaatctatctttaaaaaaaacagagtaatgcggtaggaatcaagacttagtgatgtatgtgttggggttcccatcatggcacagcagaaaagaattgacatatgaacccagaggttttgagtttgatccccagcctcacttagtgggttaaggatcccgtgttgctgtggctgtggcataggctggcagctacagctcctattgggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcttagagcaattaacaccgtgactgagcctatgggacctgcccagacaggagccctttcccttctacgatcccgtcagatcgaaatgtcctaactatagacctcaaagactctttcttcactatcccactagcaaaatcagataaaggaaattttgctttgactatccctgctgtaaacttagcacagcctgaggctcgatatcgctggaaagtacagccacaaggaagttaaacagccccaccatctgtcagctttttgtacaccaggctgtaaagcccattagagattcttttccttccactcaaatctgtcattatagggatgatattctgtttgagcatcctgattctaaagaattggaccatgtaatgactgtcttacccaccatacttcatgactatggcttccatgttgcccccgagaaggtccaaaaaatatttgggacaaacaatgttggctcaaactattaaaccacagatacttcaaataaaggctgaagtaaaaactttaaatgatgcacaatgtttactaggtaccatcagttgggtgcgtccagtgctaggtattaccaataatcaaattcaacacctaactaccctcttaaagggaaatgaaaaagacctcaatgctcccagaaggttagatgagaaatcactattggaattaccacaaattaatcagaagttgcaagaatgctcatgtgacgggaggtttgcacagatgccctttcaacctttgattttgcccacagctttaatggcaccagttatgcctgctcgaatcctaaaaatggaatggttgtttttgccttcgacaaaaagctgtacgcttacgcccgtgattaccagtatttcagaacttattttaaaagggcaaaaaagacttttagagtgagacggggaagattttgaaatcatttatttacaggtacgtcagaagacgtttgaaggaaagttacaacagtctctggaaatacaaacagccttagctgactatatagggcaagtttctgatcatttgcccaaaagaccctatgttaaaactacagagtgagattgagatgattcatctgccagtcctacagaaaaccccaatcgaaaagggccaatatgtcttcattgatgcatccgaaaaaaaatgtatgtatggctacacctggtattttaacaatgaatgtcattccatcagagggcaggatgtgggctctacacagcacttggaatggccattattaaggctttacaaatgtttcctgagccacttagcggttctcagtatacagcaaaccttactcaccaaattcctacagcaatactaaagcaatactaaagttacctagtgatgagagatttgccttccttctttctactgtttatgctttagttaatacccagacccagcctctgtatttgactcagattcactcacatacctccctgctgggatggttttatgaaggaaacgaaaggactgaggccccccgtctcttgtttccttgcaagggaagctggacagtcaccttcctttttccatgaaaactggagatctcttcaacaaggtttactatttcatcacaactagctaaacacgttgtccgggcatgtcctgactgtcagtttcaggctcctgtttctcacagccctggcaccaatcctaggggattacaacctaatgccctctggcaaacagatacaactcatgttccagagtttggtaacaagtgattcttacatgtctccattgatgcctattctaaggttatctttgcttctgtacattctaaagaaacctccaaagctgctatacaacatttactgggcgcctttgcaacctggggtgagcctcaagaaataaaaacggataatggtccggcttataccagtcatacattaaaaaaatctgccacacttagggaactcagcataaaaccggactcccatacaatcctactggtcaagctgttattaaacatgcccatctcatactcaaaaccctcattaaaaaacaaaaatggggagttcccgtcttggcgcagtggttaacgaatccgactaggaaccatgaggttgcgagttcagtccctgcccttgctcagtgggttaatgatccagcgttgccgtgagctgtggtgtaggcagatgtgactcggatcccgcattgctgtggctctggcataggctggcagctacagctccaattcaacccctagcctgggaacctccatatgccacgggagcggcccaaagaaatagcaaaaagacaaaaaaggggggggagtcagatatggtgggctattccacccccagaagtacaagtcaatatagctctctat

SEQ ID NO: 189 - DNA, 2206 bp, artificial
  ss1673 sequence
atcgtgcagggagtagctgaaggaaatcgtatgattcctgctgattggcatagcttaacccgtgctgtgctatcacctagtgaatatttacaatttaagtcttggtggcaagatcatgcccaaattactgctaatcgtaatcaggttcgaaatcttccaattacaatggaacaattgttagggattggtccttggagtaatcttcaagatcaattaagaatgaatgatttggctattgaacagattagacaatgttgcttaacggcatgggataaaattgaatctacgggtcaaataaatatttcttttcaaaagatcctacaaggccctaaggaaccttatactgaatttctagctcgtttacaagaggcattaaaacgacaagttactaactctgaggtgtctgatactatttttcaattgttagcatatgaaaacgcaaacactgattgcaaaaaggccataggatttttaaaaggaaaagctaacatagccgaatatattaaagcctgtcagggagtggggacggagtcctttaaggcctcaatgctagcccaagcaatggctaatttaaaagttaaagacaaattttcaggaaaatgttttaattgtggtaagacaggacatattaaaaaacaatgtcgcgctcttccacgagcccgacctttctttcacggagcttcagcaccttctagtaacaataataaacagccccgactatgtccaagatgtaataaaggaaatcactgggctaaccagtgccggtccatctttcataaagatggaacccccttgttgggaaactaccctcggggcaagcttccagccccgtcaaccaaggaagcattccccattcagaacaagagccagactccctgaaactatgctctgcaccagcgttcgacatcacagtagatctccctagtttacaggatttaattctccttcctagtgaaactcctacttctactacaaccaagttggaaaatccattaccatcagatacaataggattgataataggaagggcagagctaacagaacaaggagttcgagttcataccaggatattggataatatcggggatgataaagtacaagtgatggtttccactgcgattccttggaaaattaaaaaaggggatcggattgctcaaatcttaattttacctagaatccagaagaaaaaagacaggaataattttagacagaagagattcaataccacaggaggggcaggagtgtttttatcagaaaaggtcctagaggaacgacccacttgtcaagttatcataaatgggaagtcttttagaggattgattgatactggtgctgatgtttcaatcattagccatttacattggccagacacctggcctcttcagccagctgatattgaagtcactgggttaggaaaagcagagggtctcaaaaagagtgcccaatggcttaattgtgaaggaccagatgggcagccagctagattgaaaccttatgttgctcaactccctatcaatctatgggggagagatttattacaacagtggcatgcagaaatttacttaccaccagtagatcaatatagtcatcaaagccaaaaaatgttgcagaaacagggttacattcccggattgggattaggaagacatcatcaggggagagtggaacctattgaatctgagattaaaatggacaaatctggtttgggatatcggccttttcattagcggccactgcttgtaaaaataattatgtttctcctgaacctattcgactgaaatggactacagaaaaaccagtttgggttgagcagtggcctctttcttcagaaaaattaaaggttttaagtgatctggtccaagaacaattagagaagggccatatagaagaatcctttagtccctggaattcaccagtgtttgttctacagaaaaaatcaggaaaatggagattgttaacagacttaagaggagtaaatgctgtaattcagcctatgggtgcccttcaaccaggcctcccatctcctagtatgataccagctaactggttgttaattatcttggacctaaaagactgctttttcacaattcctttacacccagaagataaggaaaaatttgctttttcagtcccagtggtaaacaatatagcccctagaaagcgttatcaatggaaggtacaaatttctggtctccaggaaaactta

SEQ ID NO: 190 - DNA, 6707 bp, artificial
  ss1707 sequence
tgtgtgctctctgtccaagccagcagccctgctaatcaggtacccagcattgcttatcagttctgcttctgtaaccttgcttcctcagtttcttagggaggaacactgtctgcttggggatgagagaggtccgggatgcttacatgggaaaatcaagaccttgtagtgtataagagttactgagaacaaagacctggtgctcagactctgaaggtgactcctctgagcctgcaccggtgctgaataaaccttgcttttccatatctccgagtgctgtttgtctccttccactgccacggtttttgcagtttccgcaacattttggtgggttggctgggaagccaacaaccgagctggcctcttgtgccaccgttgtcggggaaccgggggaggccatggtcgctggcccggtgacaggtggaaagtgcgcaccggccattttgctggatccagaccctcacttgggccttggccttggcccacaccgcttcccgaacggactcagaaggagagtggaaacaggttcctggacacaacgtcagactggtgagtgccctggagacatctgcccaagtcaggacccaccatacagcggaaggagagactgatcacctctcagtgactaaagggtcactcgggtcagggtttgctcccttgggatcgggaggcttgtcaattctggtgtgtgtgtgtgtgtgtgtgtgtgtgtgtgtgactggagagaacgagagcccgtgctccaccgtctttgggtctttggactacggagccagagtgagtcctaacctgcagttccgtggcaaccctcatgcggcttatggtggccctctttggggggatccggacgttggggtttatacagtcccacctatgctaagaggcacctgaaatatctcctccaggggagcggtcaggcggatgaagcgattgttacctgaggccttgccctcactgtttgtcttgcgtcaccggcacagggtgggacttcacacaatgggtaaatcggcttccaagcccattgtcttagagtatatggttaagaattttaagaaagggttttctagagattatggtgttaagctgagtcctggaaaactgtgtaccctctgtaccctagagtggccctcctttggtgttggctggcctccggaagggaccttagatgtgttcacagttgcagcagtatataatgttataacaggagaccctggacacccagacccatttccgtatattgatcaatggttggaaattgcctatttaaggcccccatgggttcggttctgcaccacagaccagggacagtgtagggtgctagtagcccagtccaagaagaaaaccttgtctcaaaagaaggtgccacctatttatcaaggggaacctgaggactcgccccctatgcctccaccttatgtgctgccggccccagctccaggagccgaagatccccagatgccagatagcccactgccttctgtttctcctcctccttctgcttctgaagttccggaggtgatatcacccccacagccagattctccagaacctatgagcaggcgtctccgttcagctcagggagcagccactccagcattacaaatgcccttacgggagacacggggaccacagcaagtcacccccgatgggaccatacaagaggggggacgtttttattattaccagcccttttccactgccaatttcctcaactggaaacaccatactcgctcatattctgaaaagcctcaggtgctggttgatctcttagaattcattttccagacacactgtcccacctggatagactgctggcaactcctttttactctgtttgacaccgaagagtgctggtgaattgtaacagaagcccaaaaatggcttcaggccaatgcggggggtcgagcagacttggcaaactgggtgagggaagccttcccagaagaaaacccccactgggactatgacactgaagaagggaaacgtaacctagagaggtacgggcagaccttcctacagggggcaaaagctggggctaaaaagcccactaatatagctaagatcagtgagatactacaagagctgaatgaaagcccagccaaattctatgagagactatgtgaggctttcagaacctacaccccttttgatcccgaggcccctgagaaccaacggatgataaatgctgcctttgtgggataagcccaatcagatatccgtaaaaagctacagaaattagaaggctttgcaggagaaaatgccactaaactgttggaaatagcccacaaggtttttattaagtgagaccaggtggcccaccgtgatgcagaaacattctctacattgtaggggacaaggcacaaggccagggaaaaggagtcccctggaacatgaccaatgtgcttactgcaaagaaaagggacattggaaaaatgaatgccccaaccgtcctgagaaaaagaccaaggccccacctagccggtaccgatctgagccattcagcactaacctgatcagcctagctgagtctgattaggggggaccaggctctctccaactgggcccccgagagcctatggtcagaattcaagtagggggccaccccatagactttatggttgacacaggtgccaaactttctatgattacacaacctgtggctcccctcttggggaaagaaaccaccattgttggggccacaggtaaccaaacccacaggcccttctgcggtcctcgacgatgtcggttaggaggtcatgaagtaatacatgaatttctttacctaactgactgcccagtccccctgatgggaaaagacctgctggctaaaatggggacacaaatttccttttctactgatggatcggccccactcaaattgacagaacccccctctcctttaatcatggctcttgctgtaaaaagggaagaggaatggcgcttgtactcttccccttcagaaatggggacctttccctcagaactagagactaaataaccattggtttgggccgaaggaaacccaccaggtctggcaaaacgccatgctcctgtcttaattgatctaaaacccggagctcaaccagtaaagctacggcaatactcaattcccagagaagctcgactgggaatccaggttcacctggataggctgcttcagcatgaactgttaataaaatgtcagtccccttggaacacccctttactgcccatgaaaaaatcgggaacacaggactgccgcccagtacaggacttgagagccataaatgaagcaacagtcacattacacccgtccgtccctaacccatataccctgctagggctgatcccctccactgctgagtggtttactttcctgaacttaaaagacgttttttctgcctctgggtggcacctgccagtcagcccttgtttgcttttgaatgggagaatccacatacagggacaaaggaacagctcacctggactagactcccacaaggattcaaaaactctcccactctttttagtggcgccttagctgcttacctggctgaatttcctggacaaaaactgggcggtgttttgttacagtatgttgatgacctcttactggctggcaccacggaggctcagtgcctagaaagaacaagagctctcctttccctactgatggaggcagggtattgggtatcaaagaaaaaggcacaaatctgcaaaaaacaagtcaagtatctgggcttcaacatcatgcagggctgacgaatgctggggactgaaagaaagcaggcagtttgtgccattcctgtccctaccaccagccggaaggttcgtgagttcctaggggcagcaggattctgctggatatggatccccgggttttcagaactggccaggcctctgtatgaggctctaaaaggggaagaaaaaaagctccccttaaatggggaccaagccaggagacagcatttcagacaatcaaaactaaactcactgaggctccagccttgggacttcctcatgtaaccagagaatttaacctttttgttcatgagaaaaatgggatggctttgggagtcttaactcaagaatttgggccttagcagaggccagtggcatatctgtctaaacaaattgactcagttacagccagatggcctccctgtctctgagcgcgggcagctaccaccttgttggtaagagaggctgacaagttgaccctgggacaaaacctcaatgttaaagtcccgcactcagttgtaaccctaatggataccagggaccaccattagctcacacatgcacgaataactcaatatcaagggttactatgtgaaaatccatgggtaaaactggaggttgtacgaactttgaacccagccacttttctgccagataaagaggggccccacagaccagctggggcacaacactgcggactgtccccatttgaggatataaaagtggacttcactgaggtcacccctagtaaggggtacaaatatttaatagtttttatctgtactttttcaggatgggtagaggccttccctacccaaactgaaaagacaagggaagtaaccaaggcactcctgagagacattatccccagatagggaatgcctctgaccatcgggtcagataatggaccggcatttgtggctgaaacagtacaacaggtggcaaaagctttacagatccgatggaaactacattctgcttatcgccctcaaagttcagggaaagtagaacacatgaactgaacccttaaacagaccctggcaaagttatgtcaggaaactggcttgccctggatagacatgttgccggtggccctcttgaaagtgagatgctcaccccgagcgggaataggattctcgccatttaaaatcttatatgaaaggccacctccactaatcagtttgaaagaaaacaccagggagttgggagacttggaattacataaacaattacaaggactggggctcactatttctcagatacataaatgggtcacagacagaatacctgtgtccttaggtataacagtaaaccccacaagccgggggaccaggtgtggataaaggactggaaaaaggagcctttgaggccgatatggaagggcccctatactgtaattctaaccacccccactgctcttaaagtaacaggaatagatgcttggatccatcattctagagttaaaccggctggcccagctgacgaccgtggagagtgggagactgccctcgatccagagagacctcttcacctgacaattcagagaaggagacgacgatctcaaagccctgctctgaccacaccggaagctggtcagtcaacgcatggctgaagcttgaggaatcagcagcctgtgagcccaaatggaaggagggtttcaaaataaacattcgcattaatgaaagaggccttgaccctggagctgtgctacatttccagagaatcacgtttgtgctccaagctgcctctcacagcatctttcattccttttatgaagagataagacacaccccacctcccattccagccacaactaagaacttgttcttagccctggcagaaactattgcacaaactctcaaggtctcctcttgttatttatgcgggggaacaaacacaggagaccactggccttggcaagccagagaactggccccattagagcctcataatgagactgcataccccccaactcaccaatggggtatggctcctcagaactgctattattgggagaaattgtcttgtgaggcagggaggacggtttaatgtttcagttaaaagcctaacatgtttaggcctaaggtattataatctgactgcccaaaagactcaatggtggtcatcctccaatcgcttggccttggattatttacttgcttctgacggaggggtttgtggaaaatttaacttaagtaattgctgtctacaaatagatgacaccggaaaggtggtagaagaaattgctgactgcatgactaaactagcccatgtacctgtacaaacttggaaaggatgggatgcagacagtctctttggtaaatggttctcttggttgggaggaattaagacaatagtcggaataatcatggttatactcgcagggtgcctacttgttccctgccttgcacctctcctgataaatattataaaaggttttataagaactatggttgaaagaaaaacagcctcccacttgttacttattagtcataaccaaagggttatgactgatgatgatctgtaaagggtgcagatgcaccttgaacatcaagaggggggaatgaaatggagttttaactaaagaacaacccccccttggctaaggaggcagctgcaggcctttccagctatgctcgttactatgccacccttcttgtaataatgtaacaactgtgtgctctctgtccaagccagcagccctgctaatcaggtacccagcattgcttatcagttctgcttctgtaaccttgcttcctcagtttcttagggaggaacactgtctgcttggggatgagagaggtccgggatgcttacatgggaaaatcaagaccttgtagtgtataagagttactgagaacaaagacctggtgctcagactctggaggtgactcctctgagcccgcactggtgctgaataaaccttgcttttccatatctccgagtgctgtttgtctccttccactgccacggtttttgcggtttccgca

SEQ ID NO: 191 - DNA, 8636 bp, artificial
  ss1734 sequence
tgcctgcctgccagtcacccgatcttgcaagtctgaggttgaagtctcgctttagctgcacttagtgtcttggagtccattctttgagtttgggcaggtgagtgtttctaacgaattttgggcagggggtggggtgggggcggctcgtcagggatctctgtgcgtgcgtggagtgggactggagccagaagggaacatgtatcccaacccgattttaggtggactgctccatctggacgtcccggctgtctactgaggccatagaaagaccggagaccgttatcagaaggcagtggaggcgacacagggaagaaaagcaggtacccggcaaccaggcaacctggtgcacgagccaaggtaggaaaaatgggactctaagtactgcctcagtggctgggcattttagcaggttgagtgtgtgtgtgactgagtcgtatcctggatacaaagcaagagcggagtctggatccacagatccattctcccgagggaaatggcctgaggggggactaaatgaatcttgaggtgtgcaagaaaccttcaatgtgtgtgtgtgtgtgtggggggtaagtacatagggaaactcagacacagggtctgactgtaaatgggaaataaaagttctaggactagggggccaaggaaggagggagccaaaaaaatgtcctctgacccaccccctcccagggagagtccactggggagaatgctgaggttttggagggacagccctccagccagagacaaagaaaaacaaaaactgattaaatactgttgtttatttggcctaaggacccaatttgctagcctttggtcttttggcccaaatttggctcagacaaggattgggtgtgtcaatcgctacttcatgtaaaagttctctgttggatcaaggaattagcccccatgttcccccttaaggaagaaggaaatgagtctaatggaaaacctgggaccccccctatgatgtttgccccctccatacatctcaaaaatggggaacaggaggaccaaggggcaacaggagggacagaggaggagaaacatggagaccatgagggagccaaaccaacctcccctttagatccctgtcccaatctaaggaaggaattagagcaatgaaagtgggatattgagaacttccctctctcttgcaacagcagacatccaacatgttcccacttagggaggttcctatgggtcagggagagattggatttgtaaatgttctccttacaagtactgaagttaggaatttcaaaaaggaaatgaaaccactcctggaagaccccctttggttcagcagatcaactggaccaattcttaggacccagtttttacacctgggctgaaatgatgtctattatgaatattctgttcacaggggaagaaagggggatggtcaggtgggcagcaatgaccattgggggaagagaacaccctctggacatagagtcttgccaactgagcaaaagtttcccaatgtggaccttaactgggataataatgaccccagggatgggtcgaagatgcaagatcttaggtagttaataattaaaggaattaaagaattcattcccagatcacagaatgtctttgaaagcatttgaggtttaggaggaaaaggaagaaaccccctctgctttcctgcagagacttagggatcaaatgagaaaatcctcctgattagatccggaggacccagtcaagcaaggattttaaaggtgaactttgtaactaagagctggcctgatgttactaagaaattacaaaagattgatgggtggaatgagaaaccctttgagaaattactgagggaatctcagaaggtttttgcaagaagacaagaggaaaaacagaagcagaaagcaaagatcatggtttctgctgtaaaagaggtagtcaagaaaagattagattgagatcctcctcaaagggggcaaagggaatttaaactttaacaaggaggaatcagagagatgcagggaagaactcctaagactataagtagatgttataaatgtggaaaaccaggacattttaagagagactgtccagaatggaaaaaggaagaaaaggtgatccccctcatgagctttgatgaggattaggagggtcaggagttccttctgagtaggtcccacaaggaactcttgataaatttgagggtgggacctgaagaagaggaggtgacatttttggtggatactggattggctgtctcctctctaacacatcagccaaggggaacggaactctctgaggagaaattaacagcatcaggggtaaaaggggaggggtttcagcttccaattttcaagaaaatgttaatcaaattgggatcaggacaagtggagggattgctcctatatgttcttgaaacaggaactaacctcctgtgtcaagacttaattgtgaggctaggtttaggattaggaatagaagagggacaaataagagtaatgatgggtctcttaacagaagaggaggaaaagaaaagtgatccccttgtgtgggttagggaaggccacagagggagactaagaatcacacccttacaggtagaactaaaacaaccaggggaagtggtttgtagaaaacaatatcccattcccattgagaagaagaaagctcttcaaccagtaatagaggggctaattagagatggattttgcatgtcattgtacaatattccagttctcccagtcaagaaatatgacatgtcttgtaggctggtacaagatttaagggctataaattagattgtccagacctgccatcctggggtgcctactccctacacactccttagtaaaatcccttatgaacacaagtggttcattgcagtggatttaaaagatgcattttgggcatgccacccccccccccattccagaagtagggatctttttgcttttgaatggtaaaattctgtaactggcaggaaacagcagtatcgctggactgtgttgccacaaggcttcacagaagcccccaatatatttggccaaattttagagaaagtcttggagcaaattccaaccctccagtggaactcagctactacaatatgtagaggaccttttaatttctgaggaaaggaggatggaagtatcgggaaccaccataagcccgctcaactttttgggagagaggggattgtgagtctccagaaataaactgcaatttgtagacaaagaagtcaaatacctgtggaacttaataagtgaagggaaacagagaataaacccagagagaatatcgggtataataggattgcctctccccaaaagggaactcggaaaagaccaaaagggaactcagaaagcgattgggactaactggctattgtagattgtggattgattcatatgctcaaaagacaaaggctttatatttcaaattattagaggaagggtctgacccactatgatggcccccagaggaatccagacagtagaagagctaaagctccctccttactgctccagtcctggctctcccatccttagaaagaccatttcatctatttgtaacagtagaccagggtgcagccctcagtgtacttacccagacccagggcaggggacagggaggggtggaggttggggggaaaacaacctgtcactttcgtttctaaactcctagacctcgtctctagatgatggcctgagtgtgtacaggcaatagctgctagggctagggccttgctagtttaagagagcagaaaattaacatttgacggtgccctgagggtgagcatcccacatcaggtcaggaatatattaaatcaaaaggctgggaaatggctgactgactctcgaattctaaaatacgaagccatattatcagaaagggatgatttaattctgacaacagagacttgcctaaacccagccagctttctatggaaaggaaaggaaagccaagagatgctagaccccaattgtctagatatcctagaataccaaactaaggtcagaccagatctgagggaggccccactacatgacaggatgaggttgtttatagatggatcgtcctgggtgatcattgagggaaaaagacaatggctatgcagttgttgacagaaatcatcaatctttatgggaacaaggtagactgcctaataattggtcggcccaaacctgtgaactgtatgctctcagtcaagccttaaaatttctcgagggtcaagaaggtactatattcactgattctaaatatgcacatggggtagtgcacactttcagcaaaatctggacagaatggggccttctgaacagtagaggaaaagagttgatacatggggaattaatcaaacaggttttagaaaacctccctctcccagtggaagtagccatggctcatataaatggtcatcaaaaagggaacactatggaagccatagggaataggctagcaagatgaggcagctaaacaagcctccctagaagaagtagccaggccacttaatttgaccccaaacatccctagaggtaattagggatgagaccccaattcaccaaagaagaaaaagaagatctaaacaagataggagccatataaactcaagatggaaacttggtgctcccagatgggagagaaaggatcaataaacccataatgagggaactcatgtccatcctacacaagggaagccactggggtcctcagaccatgtgcgatgctgtactcaagagccatgggtgtacaggaatctatactattgctaaacagttttgcaggagttgtgtaacttgccagagaataaacaaaaaggtaatcagaaaacaaacaggagaggtacacctcctgtgttaaggccattccgaagtatccaaatagatttcacagaggtacccaaagtggggaaactaaaatatttactagtgatggtagatcatttctctggttgggtagaagcctatcccctcccaattgccaccactgggaatgttgcaaagacaattctagaacaagttatacctagatttggcctagtggaaaatatcccagacaatgggagtcactttacctcaaaggtgctctggggaatcatggaaaatttacctattaaatgggattatcacaccccttggcattccccttcctctggaaaggcagaaagaatggatcaaaccctcaaaaagctattactaagttaatcttagaaaccaagttaccttggacccaatgccctcactgatagcacttcttagaattaggacagttccaagaaaagatgtgggattatccccctagaatttacaataaggattctccaccttgggaggactacaaatctccccaccatggaaactaaagatcagttccttaagaactatatcatggccttatcctctactttgtcatcccttaggctaaaaggacttcttgcccagaccctgcctgagtttgcagttcatcatttccaacctggtgacttggtgctaataaagacctgaaaagaagacaagcttcaacccagctgggaaagcccctcctaaccactgaaacagccgtacgaacatctgagagggggtggacttgccatactccagttaagagtctgatacaaaaaaaaatctagagagggaagagaaagacagatgagaagtgaatgaatcactagggggacctctaaaggtaactctaagaagaaggcctaacccatcttaattcaatctactctcccttacgatcatggtctggctctggctttgggaattgatatggttgggatgggctattaggtttggagctggaggttggggccaagaatggggaaattggaaaggaactcctggatacccaattaagctagtcattaatgtgaatcagaccaaaacacccctgactataaaatttgatgcctgccaagtcttaccttgtggggatttagacagtcaaagacaactttcccaagcagataagtacctctgtcctgaaccagatgctggatacacccatgccagtccctgccctagttgggatgatgtctggtggaccactcaatatcatggttggactgtcgatacgaggtggataactgcatcctggagggccttaaaatataagataaatatatataaagaccccgtgccatataactgtgggaatttagaatgcaaccctatattaattatcatcaaaaacccagccaccctacaccaggaaccaagagtagcatctcgggtgtatgggttgggggcagatatctcaggacgggacccccgtggacgattagttctcaaattcgtcacccactagaccttgagtccacctgaaactatggtaacccccagtcccaataaccccttttatccaccaagtaatgaccctaaaagagtaaaaatttttgaagtcaaagatctgaggcaaaccttagagatagagacagggtatggagatgtgagtgcctgggttgaatgggtcaaatttttggtacaggccctcaacaaaagtgactgttatgcattcatgtgctgcaggactgtctcaggcatgggtggttccatttcccctaggatgggatactaaccctgaatgaatgcattgtatgttggctctataccaggacaaggatgcatggggtaatgaaactttcaagagtctgtcattgttctttcccacattgagaaggtcagatccaagagcaataccttcattctctctagggaatacgaactactcctcttgcttctcctggcagggggcaaagttcattaaacctgtgggagaactttcgacttgtagccacatcctaaatgttgctggtgagtcggacaacggcaactacttggctctgcttatacccagggcggatgtctggtggtattgtggggataggaatctcaaaaaccggttgccatccagttgaactgggacttatgctttagtttaattggctatacccttcaccctggcattttagcggatgacaacaggtcacggaacaggtcatgcaggaagaaagaaggcaataagcaggttccttcaattccagtacctataaagattccataggagttctgagaggggttccaaatgaattcaaagtcagaaaccagatagctctgggtttgaatccatactcttctggtggtccacaattaacaaaaatgtggattggattaactatatctgttataaccagcaaggattcatcaattatatctgagatactcttcaagggatagctggtcagttagacgctactagttgaatggctttggaaaacaggagtacactgccaatacaaaatattggcagaaaaggggggtgtttgtgctattttgggtagataatgtactttcattccccagtaacacagcccctaacagaacaattacaaaggccttgcaaggactaacaaccctagccagtgaattggctgataatactggaattaacgtcccctttacagactgattggaaggatggtttggaaaatggaagggtatggtagcttaaatccttaaatctcataattgtggcagggatcttaacagcaataggggagaatagtcccccctgtgtaagggaactaacacaaaaattaattgaagcatccattataaacaaatgtctgtgacataccaacagaataacttactgttactagaaactaaacttgactcactctcttatgaagaagagtcaacaaattctaaaacatttcatgaaccaaaagatacaaaagtaacgatgaaaatgagctcaaaaagtacaaaagaaagaggagggatttgtaagaaataataatgtttaatggtccattttcaaaagtaaatgctaaattaagaacggggaaccaccaatagctagcttgcacagcccacataatgacgtgtgactggtgtggcaatcctaaggcttacaaacctggaaagtccttgataatacataaagcaagaatttggaaaaatacttagcaactgagcctggggccatgcaaagaggtcctgggtaaggagggtggagtgcctagggttttgcaccagctcactctgttggtgaattcaaaacagtcgaatggaaattaacacctgggaagggagaagcaaagggagaagcaaaggggccgggtcaaaacggatacctaaaccgtgaagaaggagttcccgttgtggcacagtggaaacaaatccgactaggaatcatgaggttttgggttcgatccctggccttactcagcaggacccacgctgccgtgagctgtgatgtaggtcacagacgtggtttggatcctgcgttgctgtggctgtagtatagtctggcagctatagctctgattggacccctagcctaggaacttccatatgccatgggtgtggccctaaaaagcaaaaatgaataaataaaataaaatgaaaataaactaggaagaaaagagaagatgaccttgtaagggaataatgaaacttaggtgacatctgggaagattgtacaccccatagtactcagccagtgaggaactgggggagggacttgtgtgctagagaatgtaattgcttgttgtcagggcaccaggtgtgcctacctgcctgccagttaccggatcttgtaagaagccattaaagtctcctttgactgcactttgtttctctgagtcccttctttgagtttgggca

SEQ ID NO: 192 - DNA, 7753 bp, artificial
  ss1746 sequence
  misc_feature (278)..(377): n is a, c, g, or t
tgttgaaaatcctgataaatatatcttggtgacaatatgtctcccccacccagagacaggcacaaacatgtaactccagaacaacttaaaattaattggtccacaaagcgcgggctctcgaagttttgaattgactggtttgcgatattttaaaaatgattagtttgtaaaagcgcgggctttgttgtgaaccccataaaagctgtcccgactccacactcggggccgcagtcctctacccctgcgtggcgtacgactgtgggccccagcgcgctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagattatcctggctgttaaagcaattatttttcagactggacccggctctcatcccgatcaggagccctatatccttacgtggcaagatttggcagaggatcctccgccatgggttaaaccttggctgaataagccaagaaagccaggtccccgaattctggctcttggagagaaaaacaaacactcggctgaaaaagtcaagccctctcctcatatctaccccgagattgaggagccgccggcttggccggaaccccaatctgttcccccacccccttatccggcacagggtgctgcgaggggaccctctgcccctcctggagctccggcggtggagggacctgctgcagggactcggagccggaggggcgccaccccggagcggacagacgagatcgcgacattaccgctgcgcacgtacggccctcccataccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaacttggctaaggtaagagaggtgatgcagggaccgaatgaacctccctcagtttttcttgagaggctcatggaagccttcaggcggttcaccccttttgatcctacctcggaggctcagaaagcctcagtggccctggccttcataggacagtcagccctggatatcagaaagaagcttcagagactggaagggttacaggaggctgagttacgtgatctagtgaaggaggcagagaaagtgtattacaaaagggagacagaagaagaaagggaacaaaaaaaagagaaagaaagagaggaaagggaggaaagacgtaataaacgacaagagaagaatttgactaagatcttggctgcagtggttgaaagaaaaagcaatagggaaagagagagagattttaggaaaattaggtcaggccctagacagtcagggaacctgggcaataggaccccactcgacaaggaccaatgtgcatattgtaaagaaaaaggacactgggcaagggactgccccaagaagagaaacaaaggactgaaggtcttagctctggaagaagataaagactaggaaagacggggttcggaccccctccccgagcccagggtaactttaaaggtggaggggcaaccagttgagtttctggttgataccggagcgaaacattcagtgctactacagccattaagaaaactaaaagataaaaaatcctgggtgatgggtgccacagggcaacaacagtatccatggactacccgaagaacagttgacttgggagtgggacgggtaacccactcgtttctggtcatacctgagtgcccagcacccctcttaggtagagacttactgaccaagatgggagcacaaatttctttgaacaagggaaaccagaagtgtctgcaaataacaaacctatcactgtgttgaccctccaattagatgacgaatatcgactatattctcccctagtaaagcctgatcaaaatatacaattctggttggaacagtttccccaagcctgggcaaaaaccgcagggatgggtttgacaaagcaagttcccccacaggttattcaactgaaggccagtgctgcaccagtgtcagtcagacagtaccccttgagtaaagaagctcgagaaggaattcggccgcatgttcaaagattaatccaacagggcatcctagttcctgtccaatctccctggaatactcccctgctaccggttagaaagcctgggactaatgactatcgaccagtacaggacttgagagaggtcaataaacgggtgcaggatatacacccaacagtcccgaacccttataacctcttgtgtgctctcccaccccaacggagctggtatacagtattggacttaaaggatgccttcttctgcctgagactacatcccactagccaaccactttttgccttcgaatggagagatccaggtgcgggaagaaccgggcagctcacttggactcgactgccccaagggttcaaaaactccccgaccatctttgacgaagccctacacagagacctggccaacttcaggatccaacacccccaggtgaccctcctccagtacgtggatgacctacttctggcgggagccaccaaacaggactgcttagaaggtacgaaggcactactgctggaattgtctgacctaggctacagagcctccgctaagaaggcccagatttgcaggagagaggtaacatacttggggtacagtttgcggggcgggcagcgatggctgacggaggcacggaagagaactgtagtccagataccggccccaaccacagccaaacaagtgagagaatttttggggacagctggattttgcagactgtggatcccggggtttgcgaccttagcagccccactctacccactaaccaaaaaaaaaggggaattctcctgggctcctgagcaccagaaggcatttgatgctatcaaaaaggccctgctgagcgcacctgctctggccctccctgacgtgactaaaccctttaccctttatgtggatgagcgtaagggagtagcccggggaattttaacccaaactctaggaccatggaggagacctgttgcctacctgtcaaagaagctcgatcctgtagccagtggttggcccatatgcctgaaggctatcgcagctgtggccatactggtcaaggacgctgacaaattgactttgggacaaaatataactgtaatagccccccatacgttggaaaacatcgttcggcagcccccagaccgatggatgaccaacgcccgcatgacccactatcaaagcctgcttctcacagagagggtcacgttcgctccaccagccgctctcaaccctgccactcttctgcctgaagagactgataaaccagtgactcatgattgccatcaactattgattgaggagactggggtccgcaaggaccttacagacataccgctgactggagaagtgttaacctggttcactgacggaagcagctatgtggtggaaggtaagaggatggctggggcggcgatggtggacgggacccgcacgatctgggccagcagcctgccggaaggaacttcagcacaaaaggctgagctcatggccctcacgcaagctttgcggctggccgaagggaaatccataaacatttatacagacaacaggtatgcctttgcgactgcacacgtacacggggccatctataaacaaagggggttgcttacctcagcagggagggaaataaagaacaaagaggaaattctaagcctattagaagccttacatttgccaaaaaggctagctattatacactgtcctggacatcagaaagccaaagatcccatatccagagggaaccagatggctgaccgggttgccaagcaggcagcccagggtgttaaccttctgcctatgatagaaacacccaaagccccagaacccggacgacagtacaccctagaagactggcaagaaataaaaaagatagaccagttctctgaaactccggaggggacctgctatacctcagatgggaaggaaatcctgccccacaaagaagggttaaaatatgtccaacagatacatcgtctaacccacctaggaactaaacacctgcagcagttggtcagaacatccccttatcatgttctgaggctaccaggaatggctgactcggtggtcaaacattgtgtgccctgccagctggttaatgctaatccttccagaatacctccaggaaagagactaaggggaagccacccaggcgctcactgggaaatggacttcactgaggtgaagccggctaaatacggaaacaaatatctattggtttttgtagacaccttttcaggatgggtagaggcttatcctactaagaaagagacttcaaccgtggtggctaagaaaatactggaggaaatttttccaagatttgaaatacctaaggtaatagggtcagacaatggtccagctttcgttgcccaggtaagtcagggactggccaagatattggggattgattggaaactgcattgtgcatacagaccccaaagctcaggacaggtagagaagatgaatagaaccattaaagagacccttaccaaattgaccacagagactggcattaatgattggatagctctcctgccctttgtgctttttagggtgaggaacacccctggacagtttgggctgaccccctataaattgctctacgggggaccccccccgttggcagaaattgcctttgcacatagtgctgatgtgctgctttcccagcctttgttctctaggcagcgagcatggaaacagctccgggaggcctactcaggaggagacttgcaagttccacatcgcttccaagttggagattcagtctatgttagacgccaccgtgcaggaaacctcgagactcggtggaagggaccttatctcgtacttttgaccacaccaacggctatgaaagtcgaaggaatccccacctggatccatgcatcccacgttaagccggcgccacctcccgattcagggtggaaagccgaaaagactgaaaatccccttaagcttcgcctccatcgcgtggttccttactctgtcaataactcctcaagttaatggtaaacgccttgtggacagcccgaactcccataaacccttatctctcacctggttacttactgactccggtacaggtattaatattaacagcactcaaggggaggctcccttggggacctgatggcctgagttatatgtctgccttcgatcagtaatccctggtctcaatgaccaggccacaccccccgatgtactccgtgcttacgggttttacgtttgcccaggacccccaaataatgaaaaatattgtggaaatcctcaggatttcttttgcaagcaatggagctgcgtaacttctaatgatgggaattggaaatggccagtctctcagcaagacagagtaagttactcttttgttaacaatcctaccagttataatcaatttaattatggccatgggagatggaaagattgacaacagcgggtacaaaaagatgtacgaaataagcaaataagctgtcattcgttagacctagattacttaaaaataagtttcactgaaaaagaaaaacaagaaaatattcaaaagtgggtaaatggtatgtcttggggaatagtgtactatggaggctctgggagaaagaaaggatctgttctgactattcgcctcagaatagaaactcagatggaacctccggttgctataggaccaaataagggtttggccgaacaaggacctccaatccaagaacagaggccatctcctaacccctctgattacaatacaacctctggatcagtccccactgagcctaacatcactattaaaacagggacgaaactttttagcctcatccagggagcttttcaagctcttaactccacgactccagaggctacctcttcttgttggctttgcttagcttcgggcccaccttactatgagggaatggctagaggagggaaattcaatgtgacaaaggaacatagagaccaatgtacatggggatcccaaaataagcttacccttactgaggtttctgaaaaaggcacctgcatagggagggttcccccatcccaccaacacctttgtaaccacactgaagcctttaatcgaacctctgagagtcaatatctggtacctggttatgacaggtggtgggcatgtaatactggattaaccccttgtgtttccaccttggttttcaaccaaactaaagacttttgcgttatggtccaaattgtcccccgggtgtactactatcccgaaaaagcagtccttgatgaatatgactatagatataatcggccaaaaagagagcccatatccctgacactagctgtaatgctcggattgggagtagctacaggcgtgggaacaggaacggctgccctaatcacaggaccgcaacagctggagaaaggacttagtaacctacatcgaattgtaacggaagatctccaagccctagaaaaatctgtcagtaacctggaggaatccctaacctccttatctgaaatggttctacagaacagaagggggttagatctgttatttctaaaaaaaggagggttatgtgtagccttaaaagagaaatgctgcttttatgtgaatcattcaggagctatcagggactccatgaacaagctcagagaaaggttaaaaaaacgtcacaaagaaaaagaggctggccaaggatggtttgagggatggttcaacaagtccccatgggtgaccaccctgctttctgctctaacaggacccctagtaatactgctcctgttgcttacagttgggccttgcttaattaatcggtttgttgcctttgttagagaacaaatgagtacagttcggatcatggtacttagacagcagtaccaaggccttccaagctaagaagaaactgacctttagccttcctagttctaagattagaactattaacaagagaagaagtggggaatgaaaggatgaaaatgcaacctgactctcccagaacccaggaagttaataagaagctctaaatgccctcgaattccagaccctgttccctataggtaaaagatcatactttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcataagataaaaagaggagaagtcaattgcctaacggaccccagtaagatcgggcgtgccacaaaatgttgaaaatcctgataaatatatcttggtgacaatatgtctcccccacccagagacaggcacaaacatgtaactccagaacaacttaaaattaattggtccacaaagcgcgggctctcgaagttttgaattgactggtttgcgatattttaaaaatgattagtttgtaaaagcgcgggctttgttgtgaacccca

SEQ ID NO: 193 - DNA, 3212 bp, artificial
  ss1752 sequence
ttattaatatcaaacaatcaaatggagaaacatactgatttcattgccaggttgactaataatttacaaaaaaccgtggctaatccagaattacgcgagctattaatgaggatgcttgcttttgacaatgctaattttgaatgtcagaaagttttacaacctttaaaggccaaagggaagcctttagaagaacatattaaggcttgtcatgatattggttcagaaccatataaaatgcagctcttggccaagcaataattgcaattcaaaataaaaacaacagtaatgtacaatgttttaattgtggaaaagggacatttgcaaaaaaattgccatctgcctcatcggcctaaaacagttcctgtcattaataatgccaataataataatactaatagacctcctgtgttatgtccaagatgtcaaaaaggaattcattggtctcatcaatgccactccagatttcataaggatggttcctctttattgggaaactggaagaggggcctcgctcagggcccccaaaacaatatgagccagaatcaaacttggaatacagttccctttgtatatccacagaacaattaacaacaagaaacaaagactgcccagccactttttcacaatatccgacttactgaccgcaaccactggcggttcagcattagacataccagctattcataatattcttttagtgccttctatgggaatttataaaataccaactggtgtaaaaggccctataccacctggaagtgtaggattaattcttggaagaagtagtctaacaagtaatggtgtccaagtgttattaggagttattgatgaagactatcagggagaaattcggttgataaaaacagaagcccccgtatcagattaataaaggagattgtattgtgcaattattattgttaccatatagaaagactcaaaaatcacatattaagagagaatgaggctttggtagcacaggaaaacaagatttttggccaacttttatgtctgatcaaaggccaatactttccattacaattaatggaagaaaatttgaaggacttgtggatataagcactgatgtatctattatatctactaaatattggccatttacttggaatacagaacctgtccctattattttaataggagtagggacaatgaaaaatattttaaaaagtgctcagattctatcatgtgtgggaccagaggaagaagctgcaactctgcaacctctaattgctgatataccaataaatttatggggaagagatctcttgatgcagtggggagcttatattaccattcctacactgtcttctcaagctaagaatattatggctaatatgggatataatccttgcaatttacaaacacatttgggtttttcataggggccacttttccaatgacagccttatctttaaaatggaaatctgatgatctaatatgggtacaacagtggccccttccaaaggttaaattagaggctcttactgaattgatacaagaacaattacagttaggacatactgaaaaaaatactagcccttggaattctcctgtttttgtaataaaaaagaaatatggaaaatggagaatgttaacagatttaaggaaagttaatagtagcatggaacctatggaggccctatagtcaggactcctgtcacctgctatgatacctgaacaatggccaattcttattattgatcttaaggattgtttttataatataccattacataaaaaggatattccagatttacagttccatccctaaataataaagagcctgttaaaaggtacacctgataaaatacaagatactgagccttttgcttatttaggatatcttatgaccaaagggtgtattaaaccacaaaaggtacaaattcatatagatcatcttaataccttaaatgactttcagaaattattggaagatattaattggctaagacctactttgggaataccaaattatcaattaactgaattatttcaaatattaaatgggaatcctgatctcaatagtcccagacaattgtctgagtcagctaaagagcagttacaggttgtaagcagagctatacaagaaaaacagcttattcgcattgatcctgatatgccaatatcattaattgtattgcctacaaaaaactcccctacatccattttatggcaatcagaaggacctctagaatggatatatctgtctcatactcccaaaaagatcatgactacttacgttatgttgatttctcagattattgccaaggccaggattagatgtaaacaattgaatggatttgatcctatagaaatcatagttcctcttacaaaaaatagatatctcagctgtttatagaagatatgaattggcaatcggccttggcagattatgtaaggactatacatcatttccctcaacatcctgttttacagttttttaccactcttggattatgcctaaagttacaaaatcagagcccatttcttcagcagatacatattttgcagatgctaataaagatttaatggcagggtatacaggaccctctactaaaatgtggagatccaaaacttattctgtacaacaagctgaactagatgctattattcaacttttaaaagatgttcctgttcctttaaatattgtctctgattcacagtatgctgttcaggtgacttctataattgaaacaatttcattgtaagggcatagaaattctcctatggagcaactgtttattactttacaagattctgtaagggccaggtacaacccattttttattgttcatattagatctcattcccaattgcctggccctatatctgaagggaatacaaaaattgatcaattgattatgtttgcaagcccattccaataacatcaattgacacatattaataccaaaggacttaaacataaatttcatatatcatgacaaagctggaagtattgtaaaagcatgccctgggtgtgttttaacacatccaccgtctgttccagatactattaataaatagagaggaaactcatgtggttgagagaaaaatcagtttcaaaattttgttatttagcttactttcttcttgacgaacttccccgtataggtttctctgagttagcaggtctcaaacatttttccatctcaacaggtgttatttcctttcttacggacaacatccacccaatcacc

SEQ ID NO: 194 - DNA, 9263 bp, artificial
  ss1649 sequence
tggatgagtagaacaaaaccctggacctttaatactgccatccagcatcagttctattggcttgaaagatacccagcaggaggacccttgctgggtctcagcaaattttggcacttaaggtgggacaaattgtggccttttcgcatgcagctacccactaggctctggttttccctagctccagagggaggatggcagaggctttgagaggtctatgtgaggatgactgactctgatctttgagtacactctgaaggtttagaacagcagcagcctttggccaaattcagagcaactctgcccagcaatccaatacccaggtttgatactcacatagcatagcccccagagtaatctggactgtgccaccttgaacaatcatattgcggcattgtttgagatcaaagactgaaactcacacatcctgcccattgcttctggctggacttctcatggtattgggcacctgaggacaggggtaacctgtgaacaagaggcagccatagcagtcttgcctgctgtcttgtcagtagaactgtcttcctgacccttgtacaaggcagaagcagccacaccaaggctttctgccctcctttttaacctctaaaggtcaacagtagcatttttcatagttattttcagtttggtatatgtatcatacaccacttctgatctgtatcactggaaaaatcatagaaatgagttaagggaagacccagaggagttcctgaatctgattaggagaaattttcatatccaagatcccctgctgcagctgacatccaaagcctcctcaacactccctactgggggaagaaaagtccacaatctttacaaaagcctgagatgaaggagacagagaagagaaacaatgcaagaggctgacccacataaaaatatgatcctaatggaattcaggaagcaggaaagaaacctgtcaattgaaatatgataaaggaaatgaattaggaggaaaggaaaacatcactctatactaccaatgagcctgagtcactggaagggaatgcaatcctaacattgcatttcatttcccaaagtgcccccaacattaggcacaagcttcagaaaatagaaatagaacgagatatccctatctctcacctggtcaaggttgccccctgggtgtttaagaaactagatatagaggaggaaaaatcagagaataaaaaggcccagaggtaaacccacctctggttgttgccttccaatgtccattggtcagcatagggaactgctaaccaccaggtagactcttgactccggtgagtgacccccaggctccatcaaggggacagcaagccaaggaaattaggaccaatcaatgtaccatatgtaagcaaaacggacactggaagagatacctttgccacccctgagggatggaaatggtagatctggtcactaacttggaagacagatgatccaaatagatgaagaatggtggggcaagagggctcctaagttggcactccgactgaccccagctgatattgagtacaggcctgtcaaagacttagttgacactggtgccacttacttggttctgaacaccatatcagacaaactcagtcaaaagagtcgtaaaattatgggaatatcagggaaggcccaagtaaaggcagtcacagagccattagaatgaaaagtggatgaacatgtgctcacccaatccctcctgcaagtccccgaatgctctataccctgagggctactatccacctaatgagagacaaagtggagattagcaaccccttggacaaaggatatacgatgacaatgttactgactgaggacaaatctccccagacagcaagttcacctccctggagtaaatctcaaggtctgaatccagggatgcgtgagacaagctgtaggcgccagtcacatgatagtccatttaaaacctagacatcatagcctaacagaaaacagtgtaagcctctctgttgcaaggtctcctcaagcaatcccaggagtgccccgttatacatgggctaactgaccagggccttattagatcgtgccatcctgtaataccccattctctccacagagaaacccaatgaagcagtcaatgaaaccactaaggatatatacccaatattgcctaactctacaccctgttgaccactttaccatgctattctgtatcagattcaaaagatgcattcttctgttttctattagcccagaaaaaaactttgctttttataagcagaatccaacatgcaacaaaaacaacaatactgctggacagtcctacaccaagggttcaaaaattccttcaccatatttggggaaactttagctaaagacctaaaagacctccatctggaggggggaaaccctcctccactatgtaagcaacattctggttgtcggccccactaaggtgtcctttgacaaaagtactataaccactctgaacttatcccataaaggatataaggtgtccaagaaaaaggcttaaatatcacaaacttaggtgacattcctatgctttattctcacagaaagtaagagaagcctaccccaggaaagtaatgaggccttatttctccaaaacctaaaagacagtttagggctttcttggggatggcttggttttgccacatgtggatccttaactatgatctaaaagctaggtctctatatgaaaagttgaaaaggaaggatgatctttttgaatgaaattcagaatgcaaaggggcctttcaagaattgaaaaagtaattacttcaagcccctgccctggcccggtcagatttagccaaaccctttgacctttatattcatgagaggaggggaattgcccttggagtattagctcaaaaactgggacctcttactcagttggcttatttctctaaatacttagtttaaaccactaagggttatcctccttgcctgtgggaagtaggagttactacaaccctgctaaaggaggctgaaaaagttaatgtttggtcagccaatcactatatggactctccaccaggttcaaataaattctaagggaacagatggccattccccagaagggtgatactagttcatactatgtttattttggaaaggggcatgcctgtggcatgtggaaggtcccagggcagtgacaatgctggatccttaatgcactgagtcaccagagaactcctacactatgcttttatacaaggtggtggctaccatgaaaactggccacatggagagttcccgttgtggcttagtggttacaaacataactagtatccatgaagatgcaggttcgatccctggccttgctcagtgggttaaggatatggcattgccatgagctgtggtgtagcttgcagacacggattggatccgtgtggctggggcataggctggcagctgcagatctaatttgacccctaccctgataacttccatatgccataggtgtggctcttagaaaaataaataaataaacttgttacacaataaattctgctaccatgctacccagagaagtggagctcctagaacatgactgtatagaaaccatataaaaaatcgattccagttgcctcaaactaggatgtgagcatctcctaaatgttgaagaagaatggtttacagatggaagcagttttatgagagagagaaaaagcctggcaggatacattgtgacctcccagacctgggtcataaagcacaaagcctacccttcaatttctgcccaagctgatagccctcatctgagccttagagctcagagcagggaagatcttaaatattcacacagattctcagtatgcctgtggcaccttatacacatacagggctatttggaagaaaaaaggtgtgctaactgcagagaataaatgtgtgtgacaaggcttaagtatattgaaactcttagaagaagtacagcaaaaaaggttgtggcaattcattgcaggggtcaccaaaaaggggaatgcagcgttaataaagggaaacagcaaggctgacccaactgccaaaaaggcagctctagaccagtaacttggcaactattcctcataccttgaaggccagatccattcaatcattccctaatttacacaaaggaagagagcacaaagcccaaatggggattcagtagagatcctggagaccatgagtggctagttaatgaacataggcaatgcttgtttcccaaacttcggcttgtcaagccattagggagtctcatcagggaactcactataggaaggaagccctttataattggttagttgaggtcatagtaactcctggcatgagaaatataattagctggattgttgagacgtgctccatctgcataatgaccaactttaacaccagcccccccccccccccacacacacacacctcagaagcccccaggtgaggcctgttcagaacagaggaacatatcctggaaaaatgtagaagactgatttcactgtcatgctgagagtactgggtgacttcaggtatctcttggtgctagtagacacattttctgggtggatggaagcatttgctgctagaactgaaatggcaactgaagtggctaaggcattactaaaagaaataatcctcaggtctgggctcccagggtccctacaaaatgataatggtccaacatttgtgtctcaattgatgaaagggataatgagtgtcctgggcacaaaaaagagaacttgcactcagcctggagacctcaaatgttgggaaaagtagggcaatccaatcagatcttcagaggggtctgagctaagctatatcaggaaacataaaaaaaaaaaatctggattaatttgcttccaattgttctaatctgcatgaaattaaactcaagggataaataaaaattaaatgaatctgaactcaggtatggtagatccattccccaagcctaaaagaaaggatgtcttaacctccttgtatgccctccaggtaggagagttctcacagaatatggtgccacctgcacccactgatctgggccaacatcccttctggcaaagtaactgggtgtaacataaaaacctggggaaaaaaaaaaaaaaacataagatcagcttactcctaagtggaatggaataaatcctaaccacccattcttctccggagtaaatcctaaccacccattcttctctagtaaatcctaaccacccatttttctctggagttgcaagagacctctctgtgggcacatcacactggagtgaagagggtccccaagctctgaactccagagagaaaacttgaggcaacaggcccctttgaacagtcagggctgaggcctggtgacagttaagcacatataaataggcaggtagggataagttctcttccctacatgaagttatgaggattcccccaatcaacagaaagcagttacataagacagacttttgttccctcaatacccctcaagaatgagaagcaggacaaaagacaaaggaggaatttgtcacctgcaaagcccattgacaaaatagaatctggataatagaatctaaacttccttttttttttgatggcagtgcattgccaggggctgcaatctggagcatgagcagcacaagggccagtcctatgagaactccaattcctcctttccctgctgtcaagatccctgtaaagcagctccactcacagcctttgggggagaatgtgtcctttagagtgcaagctaatatctctccattctttgatcaaagaataaagctttccttctaaatcaaactctttcttgttctattggctcaaaagacaccaggtaggaagaaccttgttgaggcctgactcaaaagggtcagttacatttgcacttagttgcttttgcatttatactatcaccatgagaaggacatgcctaggttagtagcctgatctcccctgggatggatggatcctcctgggaataaaaacacagattgagacatgtggatgatagagacatccaggcctaggtgacctgagctatctgtgggtatgaagttatctcaaccaaaatcatcagaactgcccagctgagcttagactagatcagcagactcttgactgattagcagaggcatgaaaaaatgactgtttaatgttgcatggtactgagattttgaagtgatttgttatgaagcaaaagctaatggatccagcaacatttaatgaccaaaattagtggagtgacatctacaacattctcatgggaataaggaaacttatatccaggctatttgtcttttacatgaaatcactacaacttatttgaacatgcaataataaagagaatattgttaacatgagccttctaagaaaacacaagagggatatctcctgctgttcaagtgaaactggaaattttagcaaaataaatgttactgtcatttaatatatttagctaaagatccttggttctaaaaccaagatagaatgggatgaacgaatgaaatatatacattacacacactgacaacatagaaatgaaacatctaaaagacagggagaaaaatgagaaacgtagtaaaaaatagaaataatgcatgtctgattcataataactgtgagtcaaagctgacaaaataagaagtaaaaatctaaacttattcaaaaatatagaagtaaactctaagaaagatagtattcatgacaaaaattaggaggcaaagctgatgttagtgttcttgtagcaaggatctgacagctactgtaattaaaaaagaaagaagtagatatagtgtataaaatcctaagtctaaagttatgtaagagatctctcttgccctatctcacactttctgaacctctatttcactctaacaattgctatgacagctagtttcatgcagtaaccagatagagccttttttctgagccttacaactatttctgtctttcggtcacagtactttctctcaaatctatagttgggttgtgatttttgtaaaagtagtatttgttaagtattttaacaaacttggatggtaagtcaaatttcaataaaagattgcaagacaaagtgaaataaagaagtttattactcacaagtcttggaggaggtacatggcctcaagagaccacatagagaggttaaggcagggtacagataggtcctagccgcagggatccttattaggatccatgggtggagtgctttggagttccctggctaagactgaattggttaattaagaccccaaagagtggcactgtagtaatcccagtggggatcttatttcaggagggcacaaggggaaagaatcagaaggcaggagagactgtttattaccaggtgcactggggatgttacatcaggaacttacacttacttgtggttctgtcatatccagggtatgtgggaaggtctagtgtcagttcaaggcccctgcgtgcctcttggccacacaaagtggatgccaaggcaacaatattgcggactagtttaactaaattctcgacaggctgggattcctgaggaccgtcagtcattgaaaacctgaagtgtccaggggttaaaagttaacacatcaggaagcaactgcttgaccagcagggtttaagtgctactagacataccttcagaacaccctggaggacctgagcatcattacccagagccatgtatattcttcccttcattctttgttttactcttccaagcccctactcttgtttctagttccctaggaacacctcccaaaacaaacctgcataggattgcattgttggaagcacaggacaggactcaagacttaaaaaaaagaaagaaagaaagaaaaaatggcaagcactaaaacaaatataagtttgaaaatattgctgattatatataaaaaagtcacagttggcatttatactactgtagtttgttacctactttcataattgaaggaaatgctaaatttaagatcaaggttggagttcccaccgtggcgcagtggaaatgaatctgactaataaacatgaggttgtgggttcgatccctggcttcgctcagtgggttaaggatccagcgttgctgtaagctgtggtatatgttgcagacacagctcggatctggcattgccgtggctgtgacgtaggccagcagcaacagctctgattagacccctaatatgccagcctgggaacctccatatgccacgggtgtggccctaaaaagacaaaagacaaaaaaaaaaaaaaaaaaaagatcaaggtaaaggaaaactaaagatatcatctcacttgcatccaatttcatgaactcactgaattccattgatagaacactaagtttaaaattcctgctataataactctttgattttcatagcaaatcaacttatgagttgatttaatctttaatactattaaagaacttatattatatattccaaggcaatttttaaagagctctaattgatctttttaatgtcagtgatcccatatataccaaaaaaaatctatgtattttcttacgtatatgcaactataaaatttacacagaatgtgcttagttgctcattatttacaaaagaggacaacatttgcctaaaacgtcttgactagtaactgcaggcagctggcctaggcccaggttaccagaaggattccttgccagaagtgggtagagtaagctatggagtttttatatctggtattacatcctagataatccatttaactatatacactctttgagccttattttcaaattgaagatgatataatccttttacaaaatgtattatgaagattaaatcaaaaaaggcatttacagaatattttcattcattaaagattttctggcaaatacactgagagtatagaggtggtcactgttataaaaactatttcattggtgagatgagaatgagatttacatgaatttacatgagctgagaatttacatgaagtaaacggaggaatggaatttggatagccactgaatgtgaaaaatgtgaatagctcatcaaataggtagtcacagtcatgctagacaaaggaatctctttccaccttctccccaaataacttaagtagtctagagaacattcctactggaaaaaattaaatagtctcttcctccaagtaaagagaggaatgggaaaaatgggtgaccaatgcaggctgagtttccccatattcattactcaaagaagttgttccttctctgaaaaagatgccctgaatggaacactcctcacatacaaggaaaatgcagaagtggagaataagtacactatccattgaaagatgggaattttcatgtcccttca

SEQ ID NO: 195 - DNA, 7431 bp, artificial
  ss1662 sequence
aggcagaataataattccaatagttagtgtaggaacacgggcttccatatattccctgattaatgtccacggttttaaatttgtaaaaacaaatcaagataaacagcccttgcttgttggaagattaactactgaaagtacatctgtggacattaacctctgatctacacatttggctgctagaaaaggaatgtaaagaatggcaactctaagtctaagggaaagaagaacaaaaggaccataaagcctatggagtatatcctgactctaagcccctattggacaaggcccagtataggtgctgggcaaggccaacagggagcaggactgatagcaggaccccatgttggtacccctgtctttaagagataacacctccttagaaagttagtgtgtgggaaatcttcctctccctcgcagtgtctgtgctgggagctatctgcctttctctaataaagacttttgctttcttgctgcctgtgtgttcacaaagttcattcttcagctccgtgaacaagaactgggattccggtaacatctttccggggcctgtccaagatctgatacaccagcactcataaggtaagcaagcttgtgattttgctttctactttgttcagttcctatttgcctcttgaaaggagaatgaatgtgtgtgcctgagacgtgtcatggacacaaagccagtgtggagtcctgatccaagtttccatttaagcccctgagtgacctcatatggctataaggcagaccttctgagcccagtcagaccaggagtcccagtcgggggtttacatggacttgccatatgctgagaggcaccaaacgggatgtcccacgagggagacggccaaagacggctgaagcaagtcacaaggcaaactttacaacgtggccttccccttctcccaccctgggtactcctccctctatatactctagcctttgtaaagcattttggaaaccacaagttactttattcctgaggattagcaattttcaaaagacctgtcataaacaaaaatactgtttttgagacttttttttttttttcgtctttttgctatttctttgggccgctctcacggcatatggagttcccaggctaggggtctaatcggagctgtagccaccggcctacgccagagccatagcaacacgggatctgagccacgtctgcgacctacaccacagctcacggcaacgccagattgttaacccactgagcaagggcagggaccgaacccgcaacctcatggttcctagtcggattcgttaaccaatgcgccatgatgggaactcctgtttttgtgacttcttaaaaggtgagggagggtttaaagtagccgtccctacccccttacgagactcacctccatcttccctattttttacagcatatcaggaagcagcatatcacagtgagcaatgttagctgagtggccagagtccagtttttaatggaaatccatcttttagtggcatccctaagaggacaagacacagggaggccccttacactgtgggaagaagatctaagggctatatggataaaggtcctcataatccagttttataagcttagagaataccccttaaattacaagtccatcccattgtaaagcagatttgagaaaatttactgacgatccacatagatacacagaggtctttcagggtctcacgcaatctttcaagttgacccggagggacatcatgttattgctgaaccagacattgactacaaatgaaaagaataaagttttagaatgaatatgctcaaggccggggagatgagtggtatgttataaatgccaggagtaaatcagaagaggagctaacatgattcctacaggaggtcaggcagttcctgtgagcaatcccaattggtctacttatgagggagacaaagaaattagcataggaaccattttatcacttgtatagttgaaggcctaaaagcagcatgagtgaagcctgttaactactctaaactattggaggtctgtcaaggggaataagagagtccattggccttcttagaaaggctcagagagggattgaggaagcatacaccaatgcacccagaatcactggagggccaaaaaattcttaagaataaattcataattcaatcggcaccagatatatggaggaagctccagaaattggcttttgcccctgatcagtatccagagtacctcctcagaatagcaagtcagctgtattataatcaggaccaggaagagccaaaggaaaagaggagagacaaagaaaaggctgaggctctagttaaggctctacaaggagtcaacctgggagttttcaaggcaaaaggactagggcaaagacccaagtccagagcctgtttcctctgtggaaaagagggactctttaaaggggaaggccccaaggcttgcactctctctgaggttgactcctcaggcccaggatcaagactgatgggacccagggctttccatattgtctcctgtccttatcactacccaggagccccaggtgactctgaatgtaggaggacagcctatcaacttccttgtgggtatgggagccacctttttgatcctcctctccaaccctgggtccccttcaagtacatctgctattattcatggtgtttctggcaagccgtttacaaaattctatgtaaccttttagttgtgactgggagtctgttttcttctcttatgcctttctgattgttccagagagtccaactccacttttaggaagagataccttgtcaaaggttaaagcctcaatccacatgacagtggaaccagatcaaggcttatgcctgcctctgatggaagtaaatattgacccagaagtccgggccgttggaggaaggataggaggagcaatgaacgctcaactggtgtaaataactcttaaaaatcaaaacctattttgatgccttttttctttttctttttttttgcattcccttggctaaggcctcgccattcttatttgcctttgaggatccctctgactagtccacacaattaacttggactgtcttgcctcagggatttagagacagccctcattttttggcgaagcattagccagagacttgacaaactttaaggcttccaagcctgtcaaaattattcaatactttgatgacattcttctttgtgttgataccaaggaacaatgtaaggtgacttctcgtgatctccctaacttcttagcgtgatatggctataaggtatcaaaatccaaagctcagatttgtcaacctgaagttaaatatctgggtttaaagctatcacaagggattagagctttaagagaggaaaggatcagacttatcctgcagtacccacttcccagtactgttagacaacttcagggattcctgggcattactggatactgcaggatatggattcctggctatggagagttagcatgcccaatgtataaaatgctaaaggaagcacaacaatccagtacccaaatcctacaatgggaacccaaagacaaaaaagccgttaaggcacttcaatgggctcttcttcaggttctagctcttagcttactaacaggacatctttttaatctctttgtaatggaaagatctggagtagctctaggggtattaacccaaccaaaggcagaatctcaacaacctgtagtgtatttaagtaaagagttggactcagtaacccaaggttggccacactgcctaccagtagtagcctcagtggccctactaactttcaaggccattaaattatcagcagtccaactatctatacctctcatgatctagcaggtattctaagctccaagggtggacattgtctcttaaacaatcggcccctcgaatatcaaaccctgctattagaaggacctgtaacacaactgaggacctgttcaactttaaatcctgcaacttttcttcttgactcactagatcagaaagtcaggcatgactgtcaccaaatctttgcagccaattatgcagcaagggaggatttaaaagatcagcacttacctaatcctgacctcactatgtttatggacggcaggtcctttattgaaaaaggaggacacaaggaggggtatatagttgtaactctgtatgagaccctggagagtgggccttcgaggccaggaagaagtgctcaattagcagaactaacagcattaactgagcattggaatttgggtcaggaaaaggataaatgtttacactgactccaaatatgcatatctggtcctccatgcctatgtagccatttggaaggaatgggaatttcagacctcagacggaagtcctattaaatattttcaagaaattatgcacctcctagatgccatcagactgcttcaagaggttgccataattcattgtcgagaacaccaaaaagatgcctctgagacagctgagggaaatcaaagagcagatcgacaagctagaaaggctgctagtggagttccccgttgtggcttagcggatactaatctgactggcatccatgaggacgcaggttcaaatcctggccttgctcagtgggtcaaggatccggcattgccatgagatgtggcataggttgcagatgtggctcggatcccgtgttgctgtggctgtgctgtaggcaggtggctatagctctgattcaacaactcctcctagcctgggaacctccatacactgtggatccggccctaaaaagacagaagaaaaaaaaaaaaaaaaggctgcttgtcaaccttataatgtacaagcccctctcttctgggaagggatcccaagtgggattaaacccacttactcccctgaggaactccaatagtctctctctctggaacactttactcccctcatgctggctacagactacagattataaactggtgttgccctctagtgtccaatggaaggtccttaagactttacaccaaaccttccatttgggaattgagaacacttatcagctagaaacctgtttaaaggaaaagggctattaaagactgtgagtcaaatagttaagggatgtgagctatgtcaaaagaataccacaaagataccagtcaacccccccccccccccggtttacagcagtctgaaaaatatccaggggaggagtggcaaatagactttactcatatgcctaagtcaaaaggatgtcagtatctgttagtgtgggtagatacctttactgggtgggtagaggccttcccctgtcagactgagcaagccaagaaggtcactaaaacactaattcatgagatttcccccatttcagcttgccacagggaattcagagtgacaacggatcggcctttaaggcagccggaacccagggagtgtcccaagctttaggaataaaatatcatttgcactgtgcttggagaccacacgtatcaggaaaagtggaaaaaacatgacttgatgaaacgtcgcctacaaaaactatcacaggaaactcatcttccctggtaatccctcctttccttggccttaatacagattagggaaactcctaggagtcaggggcttagtccatttgaaatattatatggacggccctctcttagaaatgatctcctgcttgatcagcagacggctgaacttacgaagtatatgagcaatctagccgttgttcaacaacagctttcgaacttgaaaaacagtctagatcagaggaaagaaagtgagaaacctctttatcactcaggggatatagtattagtaagtccctccccaacaattctccttcactggagcctatctgggaaggaccctgcactgtcaacctttcctcctctaccgctgttgaggttgcagcacaatcttggattggattcaccacacaggaaccaaagcctggaacctggagaaagaagatgccccaccctcaactaccgaggaaaactcccctgaataccaatgcaaccctctggaggaaatcaaggaacccttccaacaaacaagggaacaatcagaatgaaacgagtggtcagtgtaattgcttttctctcctttgccatgggggattcttccacttccttacagtgggtacagggaaatgttttgtctcctgggctcactcctatgcctacttccagaatcaatcagactgctgtgtctgcagagcattacctatgtcgtttgtagaaggattccacatagggaaacaactgcttgcaagtatgtgaattcctgcatcagaatgggactgattccccacaagatctctggacagcaaataagttgtcctgtccaactccagcttttggcactaccctccagaactggttaacatcctcttcctggtggaaatgtttgtttacaacaatcgcaatcatcatgtggtcttttttttttttttctttctttctctttttagggctgcacctgaggcatatggaagttcccaggctaggggatgaatcagagctatagctgctggcctacaccacagccacagcaatggcagatctgagatgcatctttgacctacaccacagctcatggtaacgctggatccttaacccactgaatgagagcagggatcaaacctgaatcctcatggatctagttgggtttgttaaccactgagccatgaagggagctcctcatcattgtgatcttgattctcttatttggacccagtataattaattgtatttcctgcttcatcgaatcctgattagaagctattagatttcagatggtaatagaaggggaacccagtgcgatatatcaaagcccgcttgaccgtcccatgagtggagacctaactcctttcccctaacaaagccccttgtcagcaggaagcagtcagagcggtctttacccctcaccctgcagttagagtctccaactttagaggggggattgaggcggaataattctggtagttagtgtaggaacacgggcttccatatattccctgattaatgtccacggttttaaatttgtaaaaacaaatcaagataaacagcccttgcttgttggaagattaactactgaaagtacatctgtggacattaacctctgatctacacatttggctgctagaaaaggaatgtaaagaatggcaactctaagtctaagggaaagaagaacaaaaggaccataaagcctatggagtatatcctgactctaagcccctattggacaaggcccagtataggtgctgggcaaggccaacagggagcaggactgatagcaggaccccatgttggtacccctgtctttaagagataacacctccttagaaagttagtgtgtgggaaatcttcctctccctcgcagtgtctgtgctgggagctatctgcctttctctaataaagacttttgctttcttgctgcctgcgtgtttgcaaaattcatcctttggctccatgaacaagaacccagattcttgtaacatctttccggtaaca

SEQ ID NO: 196 - DNA, 8491 bp, artificial
  ss1667 sequence
tgaagggaagcccaggtcacccaggaggagatattgagaataacttctgctgattccaggcaggaacagttcctgatggcaccagacacacaatcacgcccctgtcaactgaccacacccgctaaactgtaactgatagaaataatgttgacaaaaaataggccttctaaactcccctacatattctggaagccccaagaccctggcgcaacagtctggcctcaaagccgtctgctgcccctccttgctgattaaaggcaatctggttctgttgacaccatctcatttctttcttcaactacctctcttttccttagttttttttttttttggtgccgaaccctgggaccaggacccttacagggccctcttcttgttccgccatattcccttttctccatttctttcttcctggcaggtttgtggagcacagatgcccactgagctcactctcttgccgaggctttgaagacctcttcgagaggatgccttgtgcctttgtgagcggcacaaaccccacatctggggttttattggtaatctatgtaacccccaagctcttactgtctttcctattctctgtctatggatctccagaccagaagctttttgccatttgaccatcctgcatgcaccagagtcaatttccaacccctacttaaggtaagccccggatggtgttctaacggtgccttagatcactgcccttcccaggtccgcagggaaccctccggcctctgtggccatccaggggattaaggataggggatgccctgactttccacggggttcatctttaggtctcgctgggattgtgagtgatgattcacattcatagcgagattttacacaacctaccatgggggcaaacccatctcttccaaaggcttcaccattagcctgtgtcataaaaaatcttaaacctttacttttgatggaacttaaggatccccatttaaaacaactttgtactcaaacctggccacaatgtaaattagataaccaatccaaatggcctgaattcagtacttctgatttcaacattttgtcaaatctcaaaaatttcctaaagtggaatggcaaatggttggaggtcccctatgcccaagctttctgggaccttagaggtctaccctccctcggtaaaaactgctcaacacaccaagtccttctttgctccctttctccccaaggaaacaagttcattaaaacccgaccctgggctccctccgaggattttgacactacagatgagcctcctccttagccacccaaccaaacccaagaccctatgtcaccttcttcccctgatcctgctcctgattcaacctcctcaccctctccttcccctccttacactcgctctcatagtcaacacaagtttcccttacgggaagctgccggaccagagggacccacgagggttcatgtgccattttcagtttccaatatgaggccatcatgctgcagaaactgcagaacctgtggcagcggaaggagacaaatggcacttggagatgcagaaaagcaaggtttattcagtagcagttcaggctcagaggagtcacctccagagtctgaccatcaggtctttgttctcagcaacttttatacaatacagggtcttgttttccccatgtaatccgcctcagaactcccccttcccagagcagacagtgttcctgcctaagaaactgggcaagcaaggttacagaagcaaaactgataagcaatgcttgaagcaggattagcagggctgctggcttggacatagggcatgtggttgctacataattacaagaaggatggtatgaggccagcatagctgaaaaggcatgcagctgcctttcatggcgggggtggggggggagtgtactgggtctctcagttaaaactcttacttcattcccccctctagatgttcagtcactcaagggacagacgaaaaccctgctctcttcctctcacgcctttcagaagcagttcaaaaatatactaatctggacataactactccagctgggctattatatctccacgttcatttatcagccaatctgcacccaatatccgctggaagctccgccagttagagagaggccctgacacctcctctgtagctctccataataaacaaaacatcaacaatactcctcttggcctttgttttcaatgcaatcaggaaggccactgggccaaatcctgccctaaccctaagcctccaacacggccacgccccacttgcggccaaaagggacactggaaaatggactgtccccaaaacaatccggggactcagagattcccaaaagccattctgtcaacctggcaagaaaaccagatcccaggttgccctggcacccctgaggatggacttgcccccaaactagctgggtattctcctgcctcattacttttccaatgaagaggcccaagttcctggtccccgactcttggtaccaccatgagttcggaacttagggcgatcagaagggtggccacaaaggaggtgtcatttgtggtagataccagggcagccttttcccttttggtctcctactcgggcccacttaaaccatcagaagtggctatcgaagggtctccagagttcctttctacccccaatggcaacatttttctcacacactctttcatcattgtcccccaatgtccaatggcccttatgggcagagatcttttatcaaaattaaaggcatctatccatattccccctttagataccatttccatgttcttcattcaaacggcacctgacacctctatcaatcttccttctgattcactgggatactttacccctgacctgtcccccatcgatcctcaagtgtggaatacaaatcttccttcggttgctacccaccatgcccctattcgggtcacccttaaagatccctccatggttattgctcaaaatcaatacatgctttcacctgaggctcgtcaaggcttacaacctgttataacccaattacttcaggcttctctcctccaacccacttagtctcctcacaatatgcctatattagcagtaaaaaagggaccaaactactggagactggtccacgaccttcaatgtctaaatgaggccttcattcctgcctttcccttagtcactaacccttacactctcctttcccggatatctaccggcgctaccttttttcaccgctctcaatctcaaagacgcctttttcacaattccacttcacactcactcacagcctctttttgccttcacttggcaggagcccaaatcccaagcctgccaacaattaacttggacagttttaccccaaggcttcggggacagtccccattttttcagacaagccctacagaaggacctccagacatcacaaccagcaccttgttcgctccgccagtatgttgatgatttattactgtgcagcccttcccgacaaccccatctagttcatactgctcaattattaaacgcccttggacaatggggatatcgggtgttcaggtccaaagcccaaattgctcaaacccaagtaacatatatgggtctccttctaactccacaacaaaagacaattccaccagaacaccttcaggtgttaacccatgctcccttaccacaaaccaaaagagaactcttgtccttgttaggattccttaatttttttagaatctgggtcctaaacttggcctttacagccaaacctctgtaccaagccacaaaggggcccctagatgaacccatattggcccccacttggttacagcaacccctccgaaaactaattcaaagtctacttaaagctctctccctatacttgccagattactcaaaaaccgttttcctttatgtacatgctaatcagggacatgctctggggatactttgccaaaaatcaggaggcacttggtcccctttagcctacctatctaaacagctggacatggttagcagggggctggccaccttgtttacaggctttggtggcctctgcaactctgatacctgaggcccaaacgttatctagatattcacctttgacaatttgttctccccacactttcagagatctactctcccatagaggctttttaacactccctccctcccgactccaaattctccatgcctacctgttggatccacatcttaccttctccccctgtggaccccttaatccagcaagtttattatctgaaacatcatcccacaatcaaccccctcatgactgcaattccatcctcaatacggccatgaatcccttccaacataataccgatcactctttacaaagtcctgatgcttccgactggtttattgacggcagctccctaaagtcacccccgtacacagccggatatgccacaatacagggaaatgtcctgacccctgttactcctattatcactgaatcctccacattgccccccgtccccactcacacacttcttcacaacaggcagaattagtgggtctaacttgggcactgatgtaggagaaaatgtcccgataaaaaggtagagaggagagaccccagccatgatgactaagcaaagtccagccaactgccccaaccacccctccccccaatatctgcttctgtaaacttgtttccccatctgctacactgcctgacctcacttcaatctgaccagctaagcatggacccagaagagctagcccataaaagccttgtgaaacccttcttcggggctcagactccggagagtgatctcctctgagcccgccggcataataaacctgagttctccaactctctgagtgctcgcttggtttctctccgggtaaaagagcggatacactgcagccacagagctgctggagctggtacacgacagccacagggctgtcgctagagttgatacactgtgggcacagggctgctgggcagctgccgtaacactgacactggcaaaagaaaaacaggtgaacatctacactgactctaaatatacatataacatcattcattccaacatattaatctggcgagaaagggggttccttacccagaagagcaatcccattctaaatgcaaaattgatcacaaggctattggaaacagctcttcttccccaacaggccgctatcatccactgccgaggacatcaaaaagagggcacaatagccaaatacaacaatttcgcagaccaagaagctcgaagagcagatgccccaaactctcaaacctctcagaccatctctcaaaccttacttctggcccctgcctctaatacccagggccccattaaacccccaacacagatgaacaaccccaaccctagctatgcctcagacaaggccccatgagttccagatctcaaacaaattattacatatttacattctctattccactcccctccatctgtactccatcagattattcaaaattatatacatctatccaaagatgatgttctcttcttagagcagtgttcccagtcctgcagcatttgccaaaaaacaaatcccaactcaaacctcaggcccccctcccttcctacccatcagatgagaggaaatatcttggctcaggattggcaaatagattttactcatatgctcctggacataagtgtgtggaggcctttcccactacaaacaaaagagcaaaaacagttccacattcccttataaaggaacttattcttaggttcggcctgccctcttccttacagtcagaaaatggcccagaacttacatcacaagtgattcagggactgactcgggccttatgtataccttggaaatttcacacaccttatcacccacaatcctcgggaaaggtagaacgggctaaacaacttctaaaagagacttttaccaaattaactcttgagctccatcaggactggacaaaactcctaccattagcccttctctgaatctggtttcttccctgaaaacctctccaagtaagtcctttagaggcaatgtacagccgacctccaaaaacccccttccccctactcttcattttcctgtactggaacaactcagaaacatcctgtggcaatatatggatgcccacttgccaacgccactccccgggaccccctgcccgccacctctccaaatagggtatactgtatatctggctacagaacctcaaggagacttaatccccaaatggcaaggaccttacacagtgatcctcatgacacccacagtggccaaactatggggtataccctcttgggttcatctcaatcgtctcaaagagttgttatggatccttctcctaaccacacttaacaggtttcttctacaggtccatgactttaaaattcaccaggtcaaagcagctaccaaccattccagaaactgaatgaattggatatcactaagatttcacccttcatagtccagttcctgagagacatctggattagtcctctgatgggaagaacaactgagaaaataaacacctccactactgacttttggctacagggatacttctccgatttcaccgttgatgagattacgttttttgtctttacactcttccttgttttcaataatgatctcaaaaactaggtctatatattggaccctgtctctcctttctgcctgcagcctctctattcaaatagttccttatacaaaccaggttcttcctgacctcaaatacctctttaaaaacccttaacctaactcattttctacaaaatcatcccaatcatagtctagctcatgattgctggatctgcctttcaacggccgctttggggggatcagcccctcctgtgcccaccactgaatggactgcagtaaatgtgtcccttcaccatacataccaaggggaacctctcttcctatcctacctacaatatttacacactatcggccagatccataatccagataaacttcttactgctcttttagcaggcttaacctcagccccaatacaacccactgcttcaggacatacgggaaaccatgttaccttcatacaacaagcccctttttgtttcacccgatcaccagactccaatcagctagactttcttcatgtctcttcagggtcactgccacttgaattctgcaaccagacatcccgtctttccttcccagctggaaggactatctataatgtgactggatgtcgtggtcatacgatttctcttacaggaagggtaccttctgcatataagagttcctcacccctagttggggccaacctagcagtctctaacaatcttggaacaggccacacaaatcccagaaagacttctatttgctgtagacttcacatgctgcctcagagccccaggtgtctttttcctgtgcaggaccactgcctacctttggctgcccacaaactggactggaacctgcactctcatttattcagcacccgacatttccattgccccaaataatcaaccaattcctgtcctcttgatacaccgttactctcagagagctgttcaactcattcctttattagtttactaggagtcactgctggggttgggacgggaaccacaggcattactacatctctaaattattacaagagcctgtccaaaaatctatcggacaggctccaggagatagccaccagcctaatgaccatacaaaaccaaattgattccttggctgccatggtgttgcagaaccaaggtgggctggactgccaaaaaaggggggctcgctgccaaaaagaggggtctttgcctctttctagatgaggcctgctgtttttatgccaatcagtcagaaatagagaggtggtaaaaaaacccaactaactgggcctctaggattagagaagaccttagcaattcctggcaatcgtggttgtcaaactggaattggatgccttggttactgccctttctagggcccctcatcattataactctcattttaacttttgtaccttgtctattcaatctttttcagaggttcgcacatgaaagaattcgagctgtatctcaggaccaagtaaaaacgatcctcctattggaacggctgaccaataaaatggaaaaccaacataatgatatctaaaagaatccctccattccagaccaaaaacaagaggcccccttcttttaacagcttgaagtatccagaatttttctgacatccaccatccctatatttcttttatatatctcttacagtctggaatgaagggaagcccaggtcacccaggaggagatattgagaataacttctgccaactccaggcaggaacagttcctgacggcgccggacacacaatcatgcccctgtcaactgaccacactcgctaaactgtaactgatagaaataacgttgacaaaaaataggctttctaaactcccctatatactctagaagctccaagaccctggagcaacagtctggcctcaaagttgactgatgcctctccttgctgattaaaggcaatctggttctgttgagaccgtctcatttctttctgtaaccacctctcttttcctgaca

SEQ ID NO: 197 - DNA, 5153 bp, artificial
  ss1688 sequence
cagcctcccccttatgtttcttcaaactctgactttaatcctagtgatgcctcagcacctccttcaatcctgcacaaccataagcctcctcctccccctcccacccattccgtgcacccaggtactacagcccctacaccttcttctctccctcccaccattgttcttcctcctcttcttccatgccccaagaatcctaattcccactcccaacatgcagccccctcccataacaacaaccccttttatgacccccttgacaagatctcgatcagcaatcccccctgaggccccaaaccttcctttaagagagattgctggagttgaaggaagagtcagggttcatgtgcctttgtctttgggagacttatcccaaatagggaaaatgtttaggttccttcacctcagactcaactacctacacaaaagagctccagtatcttattcactcctatgacttcacttggaaagacatttgtgttatccttagctgttttctgtcccctgaagaaagggaatgaatttgtctggcagcccaagcccatgcagacaccttacataccaagatcctactaacagtcctgttggaactctagctatcccttgtgtggatcctaattggaactatcagatagactcccaggacagaggctcgagaggccaccttatttcttgcctaatagaaagaatgaagtcctcattaaaaatagttacttaggataaaattagagaaataatacaggaaccccaagaaaatccagccatttttatgtcaaggcttatagtatactaccctaagtatcctaccctaaatctagaaagtcaagagagataaattcatttgcatatgcatttcatctcccaatcagcacaagatattaaaaaaatatgtggaaactagaggacggtcatttgttcccacgaagggatctcattaaagctgcctttaatggtctttaataatgcataggaagaacataaggcccctaaactaaagaagtccatgactgaatatcagcttcttgcttctgccatatagggaaatcctcaaaaacaaaccatggaccccctgaggcatacaaacttacagaacaacctcccctcccagggcctatttcaaaggtggcttagaggggcattgggcaaataaatgccataaccccaaaccctgccaggcccttctccaaaattcagtcagaatggacattggaaagtggactgtgggaagccagcacagcccaccatctcctccacaaaacctaccttggagaccatcaacatgaaccacctgttgggcctggctatggaggatgggtggggcctgaggccaccaggccccagcttcctaccaccactctggagcctcagggagctctggcaggagcagataagattattttgttcttattggacttgggggcattatactcggtagtacctattttacagggtcttacctacacctcccctacttctatcatgggggtaaagtggttgcccactacaccccaacagactggaccttgactttgcacacttgtaaacaccactttctgccacctaattcctaggtattcccacatgggctatgcttataatagggatgaatattttgactaagttccagggatacattgaatttcctatacaaccaaacacaaacttcctatatctgggccagtcagatttggggcccactcccccagtcattcccacctcccctctgatgtcaatcccattgtttgggacacccatataccctccattgctagacatcattctccaattctcataagactaaatgatcttcctaaatttcctatccaatctcaatatcctattagcctagaagcacagagagaatgaaagcctataattcagcttctcctcaaggccaacgtcctcaaacctactcactttctgttcaatattcctatccttcctgtaaaaaaactagacagatgcttctgattagttcaggatcttggcctcatcaatctggtactccttcccattaacacagtggtcccaattccctatactcttctgtctcgtatacctcctaacactcctcatttctcagttcttgacctaaaagatgccctttttacccttcctctacacccttcatgccaggaattatttccattcacatggactgaccacaatattctttcagaccctcagttaacctggacagtccttcctcagggttttagagacagcccacatttctttggctaaccctcagccacagatcgtaaccactcagggcactggagggccaacttacccaccagtggagcagacccatcaaccgcaactggggccatttaatttctgggctcctcctgacatggagaactggccagagggccctgaccatgtagagggaaaagacactttgttggccctttccctttccctctcccatttttctttcttttttttaattaattaaatttaaaaattttttttcttccactgtacagcacggggatcaagttactcttacatgtatacaattttttgccacccttggttctgttgcaatatgagtatctagacaaagttctcaatgctactcagaaggatctgcttgtaaatctgttctaagttgtatctgataaccccaagctcccgatccctcccactccctccctctcgcatcaagcagccccacaagtctattctccaagtccatgattctcttttctgtggagatgttcatttgtgctggatattagattccagttatatgtgataccatatggtatttgtctttgtctttctggctcatttcactcagtatgagtctcgagttccatccatgttgctgcaaatggcattatgtcattctttttatggctgagtagtattctattgtgtatatataccacctcttccaaatccaataatctgttgatgaacatgtgggttgtttccatgtcctgactattgtgaatagtgctgcaatgagcatgcgggtgcatgtgtcttttaagtagagttttgtccgattatatgcccaagagtgggattgtggggtcatatggaagttctatgtatagatttctaaggtatctccaaactgttctccatagtggctgtaccagcttacattgccaccaacagggcgggagggttcccttttctccacaccccctccagcacttgttatttgtggatttatgaatgatggccattctgactggtgtgaggtggtatctcatggtagttttgatttgcatttctcttataatcagcgatgttgatcattttatcatgtgttggctggccatttgtatcttccttggagaacagtctattcgggtcttttgcccatttttccattggttgattggcttttttgctgttgagttgtataagttgcttatatattctagagattaagcccttgtcggttgcatcattggaaactattttctcccaatctgaaagttgtccttctgttttcttttgggtttcctttgctgtgcaaaagcttttcagtttgatgaggtcccatgggtttatttgtgctctaatttgtattgctttgggagactgccctgagaaaatattcatgctgttgatgtcagagagtgttttgcctatgttttcttctaggagtttgatggtgttctgtcgtatatttaagtctttcagccatttggagtttatttttgtgcatggtgtgagggtgtgttctagtttcattgctttgcatgcagctgtccaggtttcccagcaatgattgctgaatagactttcttgttcccatttgatgttcttgcctcccttgtcaaagattaattgaccataggtgtcagggtttatttccgggttctctgttctgttccattggtctgtctgtctgttttgatatcagtaccacactgttttgatgactgtggctttgtaatatttcttgatgtctgggaaagttatgcctcctgctcggtttttgtttctcaggattgctttggcgattctgggtcttttgtggttccatataaatgtttggattgtttgttctagttctgtgaaaaatgtcctgggtcatttgatagggattgcattgaatctgtagattgctttgggtactatggccatttttacaatattgatttttccaatccaggaacatggaatatctttccatttctttacatcttctttgattaaagttttatagttcttggcatataggtcatttacctccttggtcaggtgtattccgaggtatttgattttgtgaggtacaattttaaaaggtgtcgtatttttgtattctttttctaatatttcattgctggtatacaaaaatgcgactgacttctgaatgttaatcttatatcctgctactttgctgaatctattaatctgttccagtagtttttgggttgagtccttaaggttttctatgtaaagtatcatgtcatccgcatacagtgacagtttgatctcttctcttcctatatggatgccttttatttcttttgtttgtctaattgctgtggccaggacttccaaatctatgttgaagagcagtggtgagagtaggaatcactgtcttgttcccgatttgtgtgagaaggctttcagtttttccccatttagttttatatttgctgtgggtttatcataagtggctttgattatgttcaggaatgctcccttgatacccaccaatggacagatcctcttagacagaaaaccaataaagcaacagagatcctgaaggaaacaatagaagttagatttaattgatatcttcaggacactacatccaaaagaatcagaatacacattcttgtcaacaacacatggagcattctcaagaattgaccacatattgggacacaaagctaacctcaataaatttaggagcagagaaattatctcaagtatcttctctgaccacaatgccatgaaactagaaatcaaccacagtaaaagaaatgagaaaaaacctactacatggagactaaacaacatgctactaaaaaaccagtgggtcaatgaggaaatcaagaaggaaattaaaaataccttgagacaaatgatcatgaagacacaacctctcaaaatctatgggatgccgcaaaagcagtgctcagagggaaatttatagtgatacaggcctttcc

SEQ ID NO: 198 - DNA, 4509 bp, artificial
  ss1760 sequence
gttctccattataaaaaaggaaatcactgggctaaccagtgccggtccatctttcataaagatggaacccccttgttgggaaactaccctcggggcaagcttccagccccgtcaaccaaggaagcattccccattcagaacaagagccagactccctgggactacactctgcaccagcgttcgacatcacagtagatctccctagtttacaggatttaattctccttcctagcgaaactcctacttctattacaaccaaattggaaaatccattaccatcagatacaataggattgataataggaagggcagagctaacagaacaaggagttcgagttcataccaggatattggataatatcggggatgataaagtacaagtgatggtttccattgcgattccttggaaaattaaaaaaggggattggattgctcaaatcttaattttacctagagtccagaagaaaaaagacaggaataattttagacagaagagattcaataccacaggaggggcaggagtgtttttgtcagaaaaggtcctagaggaacgacccacttgtcaagttataaatgggaagtcttttagaggattgattgatactggtgctgatgtttcaatcattagccatttacattggccagacacctggcctcttcagccagctgatattgaagtcactgggttaggaaaagcagagggtctcaaaaagagtgcccagtggcttaattgtgaaggaccagatgggcagccagctagattgaaaccttatgttgctcaactccctatcagtctatgggggagagatttattacaacagtggcatgcagaaatttacttaaccgccagtagatcaatatagtcatcaaagccaaaaaatgttgcagaaacagggttatattcctggattgggattaggaagacatcatcaggggagagtggaacctattgaatctgagattaaaatggacaaatctggtttgggatatcggccttttcattagcggccactgcttgtaaaaataattatttttctcctgaacctattcgactgaaatggactacagaaaaaccagtttgggttgagcagtggcctctttcttcagaaaaattaaaggttttaagtgatcttgtccaagaacaattagaaaagggccatatagaagaatcctttagtccctggaattcaccagtgtttgttctacagaaaaaatcaggaaaatggagattgttaacagatttaagaggagtaaatgctgtaattcagcctatgggtgcccttcaaccaggcctcccatctcctagtatgataccagctaactggttgttaattatcttggacctaaaagactgctttttcacaattcctttacacccagaagataaggaaaaatttgctttttcagtcccagtggtaaacaatatagcccctagaaagcattatcaatggaaggtcctgcctcaaggtatgttaaacagccctaccttgtgtcagtattatgtggcttcagttgttgacccagtccgaagacaatttcctaaatgctatgttgttcactatatggatgatatactttgtgctgcaccctctcgggagcagctgactgaggttttccaatgtttacaaacctgtctaaaaggagcaggattggttattgctcctgaaaagattcaaatgaaaagtccatatcaatatttgggaactgtggttgaacgtaccactgttcaccctcaaaaggtagaattgagaagagatcaaatttctacattaaatgatttacaaaaattgttaggagacattaattggctccgaccttatttggggattcctacatatgaattgtcaaatcttttctccttgcttagaggagattctaaattaaacagcccccgctctctaactgcagaagcggaagaggaactaaaaaagattgaaagtaaaatacaaaactcccaactaagtcgggtcaatctaaaacaacccattcagttagtaattataccgtctcctcattctcccacgggaatattaatgcaattagaaaatattctcgaatggctttttcttcccaataatgtcacgaagtctttgtctccgtacctggacttgatggcacaacttattctaaaaggtcgcactcgctgtgtacaaatgtccggaaaagatttgaatcatgtaattgttagtttaactattaaggaaatccaaaattgttttcaaaatcatataggttggcaaattgcctttgcagattacgtaggatcaatagataatcactatccagaaatccctgttttacaatttataaagcgtactcaatggattctgccaaaaaaggtgaaggagtcacccatcattgacgcccctgtgatctttactgatgggactagtaaagggaaggccagatatgtggctaatcaatctaaaattataagaacacctggcctttcagcccaacaggctgaactaactgctgtaatccatgccttgagggattatcctgagcctatcaatattctttctgattcagcatatgtagttcatgctgccaaaatgattgaagctgctaccattaaacaaaatttacctgtcttgttatttgacttgtttacaaaattacaaactgttgtaagggaaagaagatatccattttatattgctcatatcagagcacatactaacctacctgggcctctagttgcaggaaataaagaaattgactgcttggtgacacctgtgttacaggaagctcaacattttcatgatttaacacatgtaaatgttcgaggccttaaaaagagatttggaataacatgggctaaagctaagacaattgttcgtcaatgtcctgcatgtcaaattattaacaatccttctcaatctgagcctggagttaaccctaggggacttgtcccaagtgctctctggcaaatggatgttactcattagtcatctttcggaaaattgtcatttattcgtgtatgtattgacacttactctaaatttatttgggctactgcacagtctggtgaatctgctaaacatgttattcgtcatttgtatgcctgttttgcagtcatgggcctgccacaagcaattaaaactgataatggtccagcttatatcagttctcaacttaaaacattcctagatacatggcatatttctcactctactggtctcccttacaacccccaaggacaggctattgtggaaggagccaatttatatgtaaaacaggctcttcaaaaacaaaaagggggagacacagaaatagttaagtcacaacaaacacttttaaacaaaaccttattcactttaaattttttaaacttggcctctgatgaaaaaacagctgcagagagacattcttatacagaacaaaataagattaactttcctcatgctgaacagcccttgatttggtggcaggatccactaacaaacttctggtctccaggaaaacctattacgtggggtaggggatatgcttgtatttcaccaggtcatggattacaacctgtttggattccatcaagaagaatcaaaccatatcatgaccccagaaggaggatgataagggctcatcttcccacttggggtcaaatcaaacatctaacctgagaagctgaaacctagctctccatcgcaatcatcatcaatagattcatgagctgtcaatccagctccagcttttggagctgccctgtggaaccagctgacctcctcctcctggtgaaaatatttatttgaggtatccaaagcaatgtatcaaagcccacttgaccattccatgagtggagacctaactgctttccctaacgacgccccttttcagcaggaagaagttagagcggtcgtcgccccttttcccacagttagagtctccaactcaaggggagaattaaggtagatttttaactcaggtagtcagtgtaaggatatgggctttgatacattctttgtggctatttattaacatttgtaaactgagggtctcatagcaagcccaactgctataaaggttgtgggtattgccccatggagccatcacatcagagtgaagaaggttgcatccactgctgacgtggacaccggggaggctgtatagcacctcgagaatctcttcatggtcaagttccagggactccctttgccatcatcagagtgctaagccctgctctggccacccgtggaagctggtcagtctatgcacagcagaagcccgaggagttccacgtgagacttaaaacttggactctgagacttaacttggactgtgttctgtctatagatataagaagtgaataattcaaggagaaatgaaaaaagtttcaagacctatttttgtcttcccacaaaaacaaaaagggggagatgtcgcaagacatgtttccttgaaaactccatcttgtccttctttactttatcccatcttcttgtcttactttatcccgtcttccttcttggaaaaacagtcacagtgctggtaaatgacttaagctta

SEQ ID NO: 199 - DNA, 8920 bp, artificial
  ss1761 sequence
tggggatggggggggaggtctgggatgtttacatgggaaaatcaagaccttgtagtgtataaaagttactgagaacaaagacctgatgctcagactctggaggtgactcctctgagcctgcaccggtgctgaatgaaccttgcttttccatatctctgagtgctgtttgtctccttccgttgccatggtttttgtggtttccacaacatttcggtgcgttggccgggaagccaacaaccgagctgacctcttgtgccaccgttgtcggggaaccggggtgggccacggtcgccagcctggtgacaggtggatagtgcgcactggccattttgccagatccagaccctcactcaggccatggccttgtcccacaccacttcccaaacggactcagaaggagagtggaaacaggttcctggacaggacgtcagactggtgagtgcccaggggacatctgcccaagtcaggacccgccatacggtggaaggagagactgatcacctctcagtgaccaaagggtcactcaggtcagggttttctcccttgggatcgggaggcttgtcaattctggtgtgtgtgtatgagtgactggagagaacgagagcccgtgctccactgtctttggactatggagccagagtgagtcctaacctgcagttccacggtgaccctcatatggcttatggtggccctcttcggggggatcctgacattggggtttatacaatcccacctatgctaagaggcgcctgaaatatctcctcagggggagcggtcaggcggacgaagcgattgttacctgaggccttgccctcactgtttgtcttgcatcaccggcacagggtgggactacacacaatgggtaaatcggcttccaagcctactgtcttagagtatattgttaagaattttaagaaaggattttctagagattatggtgttaagctgagtcctggaaaactgtgtaccctctgtaccctagagtggccctcctttggtgttggctggcctctggaagggaccttagatgtgttcacagttgcagcagtatataatgctataacaagagaccctggacactcagaccaatttccgtatattgatcaatggttggaaattgcctatttgaggcccccatgggtttggttctgcaccacagaccagggacagtgtaaggtgctagtagcccagtccaagaagaaaaccttgtctcaaaagaaggtgccacttatttatcaaggggaacccgaggactcgccccctatgccaccaccttatgtgctgccagccccacctccaggagccgaaggtccccagatgccagatagcccaacaccttctgtttctcctcctccttctgcttctgaagttcccaaggtgatatcacccccacagccagattctccagaacctatgagcaggcatctccgttcagctcagggagcagccaatccagcattaaaaatgcccttacgggagacatggggaccacagcaagtcacccctgatgggaccatacaagaggggggacgtttttattattaccagcccttttccactgccgatctcctcaactggaaacaccacactccctcatattctgaaaagcctcaggcgctgattgatctcttagaattcattttccagacacactgtcccacctggatagactgtcggcaactcctttttactctatttgacactgaagagcgctggggaattgtaacagaagcccaaaaatgacttcaggccaatgcagggggtctagcagacttggaaaactgggtgagggaagccttcccagaagaaaaccctcactgggactatgacactgaagaagggaaacgtaacctagagaggtaccggcaggccttcctacagggggcaaaagctggggctaaaaagcccactaatacagctaagatcagtgagatactacaagagccgaatgaaagcccagccaaattctatgagagactacgtgaggctttccgaacctacactccttttgatcccaatgcccctgagaaccaacggatgataaatgctgcctttgtgggacaagcccaatcagatatctgtaaaatgctacagaaattagaaggctttgcaggagagaattccactaaactgttggaaatagccaacaaggttttgattaaccgagaccaggtgtcctgccgtgatgcagaaaagagaatgaaacaaaaagtgactcttctggcggccgccctgtcaaaaccggtgcccccattggcaccaccctgtaggggcaatgcacaaggccagggaaaaggagtcccctggaacatgaccaatgcgcttactgcaaagaaaaggaacattggaaaaatgaatgccccaaccgtcctgagaaaaagaccaaggccccacctagccggtaccaatcttagccattcagcaccaacctgattggccttgccgagtctgactgggggaaacaggctctctccaactgggcccccgagagcctatggtcagaattcaagtagggggccaccccacagactttatggttgacacaggtgccgaactttctgtggttacacaacctgtagtgttgtgtaaccacagaaagaaaccaccatctcggggaaagaaaccaccatcgttggggccacaggtaaccaaacccacaggcccttctgtggtcctcaacgatgtcggttaggaagccatgaagtaatacatgaatttctttacctgcctgactgcccagtccccctgatgggaagagacctgctggctaaaatgggggcataaatttccttttctactgatggattggcccaactcaaattgacagaacgcccctctcctttaatcatggctcttgctgtaaaaagggaagaggaatggcgcttgtactcttctccttcagaaatggggacaattcccccagaactagagactaaatacccattggtttgggctgaagaaaacccaccaggactggcaaaatgccacgctcctgtcttgattgatctaaaacttggagctcaaccagtaaagctatggcaatactcaattcccagagaagctcgactgggaatccaggttcaccgggataggctgcttcagcacggactgttaataaaatgtcagtccccttggaacacccctttactccccgtgaaaaaaacaggaacacaggactaccacccagtacaggacttaagagccataaatgaagcaacagtcacattacacccgtcagtccctaacacgtataccctgctagggctgatcccctccactgctgagtggtttacttgcctggacttaaaagacgcttttttctgcctctgggtggcacctgccagtcagcccttgtttgtttttgaatgggagaatccacatacagggacaaaggaacagctcacctggactagactcccacaaggattcaaaaactctcccactctttttagcagcaccctagctgctcacctggctgtatttcctggacaaaaactgggctgtattttgctacagtatgttgatgacctcttactagctggcaccacggaggctcagtgcctagagggaacaaaagctctcctttccctactgacggagggtatcgggtatcaaagaaaaaggcacaaatctgtaaaaaacaagtcaagcatctgggcttcaacatcatgcagggccaacgaatgctggggactgaaagaaagcaggcagtttgtaccattcctgtccctaccaccagctggaaagttcatgagttcctaggggcagcaggattctgccggatatggatccccgggttttcaatctggccaggtctctctatgaggctctaaaaggggaagaaaaggctccccttgaatggggaccaagccaggagacagcatttcagacaatcaaaaccaaactcactgaggctccagccttgggacttcctgatgtaaccagagaacttaacctttttgttcatgagaaaaatgggatggctttgggagtcttaactcaagaatttgggccttggcagaggccagtggcatatctgtctaaataaattgactcagttgatgccggatggcctctctgcctccgagcactggcagctaccactttgttggtaagagaggctgacaagttgaccctgggacaaaacctcaatgttaaagtccaacactcagttgtaaccctaatggataccaggggccaccattggctcacacatgcacgaatgactcaatatcaatatcaagggttactatgtgaaaatccatgggtaaacctggaggttgtatgaactctgaacccagccacttttctgccagatgaagtgggacccccagaccataactgcctggaggtactagatgaggtgttttccagcaggcctgacttgactgataaaccagtccaaaatcctgacctggttttatatactgatggcagcagctttatggaggatggaaaaaggatggcaggatatgctgtggtatctgacttaaaagtgatagaaacagaggtgcttcctcaaagctggtcagcacagagagcagaaatatgggccttaatcagagcactggaactcagccaagaccagtgaattaatatctataccgactcacgatatgcctttgcaactttacatgtccatggagccttatataaagaggtctcctcaatgctgaaggaaaaggaattaaaaaccaagctgaaatcttaaagctcctagaggcagtatgggaacctaaagaagttgcagttatccactgtaaaggccaccaaaagggagatgactcagtgacaaaaggaaactgtagtgctgatgcagctgccagacaggcagcccagggacaacagccagacaaacctaaggtcttgctggccccagaagtgccagctgtccccaaatattctccagaggaaggaaaatggataagggaggaaggaggaactaaaactaaaatgggatggtgggtcacatgggaccacgagtttacattccagaacagctggcctacaaactagtctgccaagaacatgagctaacccacatgggcaaaactgccttagaaaccctactgggcccgtactatctcattgcttgtcttcctgcactctgctcctctgtctcccaaagatgcataacctatttacagaataatgcccaccaggggccccacagaccagctggggcacagcactgcagactgtcccaatttgaggatatggaagtggactttactgaggtcacccctagtaaggcgtacaaatatttactagtttttatctgtactttttaaggatgggtagaggccttccctacccgaactgaaagggcaagggaagtaaccaaggcactcctgagagacattattcccaggtatgaaatgcctcttaccattgggtcagataacggactggcatttgtggccgaaacagtacaacaagtgacaaaaactttacagatccgatggaaactacattctgtttatcgccctcaaagttcagggaaagtaaaatgcatgaaccaaacccttaaacagacactggcaaagttatgtcaggaaactggcttgccctgggtagacatgttgccggtggccctcctaaaagtgagatattcaccccgagtgggaataggattctcgccatttgaaatcttacatgggaggccacctcctctaatcagtttaaaaggaaacaccagggagttgggagacttggaattacataaacaattacaaggactggggctcactatttctcggatacataaatgggtcacagacagaatacctgtgtccttaggtataacagtacacccccacaagccgggggaccaggtgtggataaaggactggaaaaaggagcctttgaggccgtatggaagggcccctatactgtaattctaaccacccccactgctcttaaagtaacaggaatagatgtttggatccatcattctagagttaaaccggttggcccagctgacgaccatggagagtgggagactgccctcgatccagagagacctcttcacctgacaatacagagaaggagatgataatctcaaagccctgctctgcccacaccggaagctggttagtcaacacacggctaaagcttgaggaattggctgcctggtaaaataaactgccttacctcccttccacaagagactctcttactgtcatatgctgttatcttatgaccaacatgtatgtttgctgcctgttgctgttaatctggtcccctttggttctgccaggatccatgtcctcatgtgacccgtgcatttgagtgacccgatcagatcaaggggttacatggactttgctttactccactcatttctcctgttccgcagaaattcatggaagttgtactcacaacaggaccacttattctatccgccaacagggggaccaatatacttgctttgatccatgatactcaccaactgaggaatggttagaagtccggtgctctcataaatcagggcagctaattaatcggacccaaattacgaaccccaagttgccagtatcaatatttttgatgcctgtgaagttatgaatgggtcatggacttctactagaccatgtggaagcccatcatgggaaagagaatataggctccagcataaatatatgtgctgggggaccacctggagcggttgcctggaatgcacttactggagctgtgtgtcctgggcaacctggaataagggagacaaaacagctgtccttcaaaagggtacagcccctccagactgccagactaaagcttgtaacccagttaatttcactattttcaattccagtgagcccaaatggaaggagggtttcaaaataagcactcgcattgacggaagaggccttgactctggagctgtgctacatttccagagaatcacgtttgcgctccaagctgcctctcacagcatctttcatcccttttatgaagagataagaaacacccctcctcccattccggccacaactaagaacttgttcttagccctggcagaaactattgcacaaactctcaaggtttcctcttgttatgtatgcgggggaatgaacacaggagaccactggccttggcaagccagagaactggatccattagagcctcataatgagactgcatacccccaactcaccaatggggtatggctcctcagaactgctattatagggagaaattgtcttgcaaggcggggaggatgatttaatgtttcaattggaagcctaacatgtttaggcctaaggtattataatctgactgcccaaaagactcaatggtggtcatcctccaatcgctcagagcccaagcctaatcccttgtctaacttttcccaccttcgacaagcatgggaagatatcagtactaatatccagtggtggacaccaaagggattatattggatttgtggaaaaatggcctattccatactccccccaaattgggctgggcatgtgtactgggaacaatcagaccttccttcttccagctcccgctgtcactaggggagcaactgggagttcctacatatagggcacagggtgccctgagagaccagagggctctccaagttggagagtggaaagatgataaatggcccccagaatggataattcaatattatgggcctgccacctgggcagaggatggctcttggggatatcgcacccctatctatatgctaaactgcatcatcagactacaggtggttttggaacttataacaaatgacactgcaagggccttgactatattggcccaacaacaaactaaaatgcacagtgcaatctaccaaaatcacttggccttggattatttgcttgcttctgaaggaggggtttgtaaaaaatttaacttaaataactgctgtctacaaatagataacactggaaaggtggtagaagaaattgctgaccgcatgactaaacttacccatgtgcctgtaaaaacttgaaaaggatgggatacagacagtctctttggtaaatggttctcttgattgggaggaattaagacgattgtcggaataatcatggttatactcgcagggttcctacttattccctgacttgtacctctcctgataaaaactataaaaggttttataagaatcatggttaaaaaaaaaaacagcctcccacctgctacttattagaggctaccaaagggttatgactgatgatgatctgtaaagggtgcagatgcaccctaaacatcaagaggggggaatgggagttcccgtcgtggcgcagtggttaatgaatctgactaggaaccatgaggttgtgggttcggtccctgcccttgctcagtgggttaacgatccggcgttgccgtgagctgtgatgtaggttgcagatgcggctcggatcctgcgttgctgtggctctggagtaggccagtggctacagctccgattcgacccctagcctgggaatctccatatgctgcgagagcggcccaaagaaatagcaaaaaaaaaagaggggggaatgaaatagagttttaactaaaaaagaacctccccttggctaagaaggcagctgcaagcctttccagctatgctcgtcactataccacccttcttgtaataatgtaacgactgtgtgccctatgtccaagccagcagccctgctaatcatgtacccaacattgcttatcagttctgcttctgtaaccttgctcgctcagtgtcttagggaggaagactgtttggttggggatggggggggaggtctgggatgtttacatgggaaaatcaagaccttgtagtgtataaaagttactgagaacaaagacctgatgctaagactctggcggtgactcctctgagcctgcaccggtgctgaatgaaccttgcttttccatatctctgagtgctgtttgtctccttccgttgcca

SEQ ID NO: 200 - DNA, 8273 bp, artificial
  ss1778 sequence
ctggacttgaggacctgtaaatctgtgctttaccttgggtcttcattccatggctctgaatcatcatctgactttttcactcaagctcagtttcatcatccaaaatagtttaattagtcacaagcattaaaaacctagtacattgaaatcaaagttctacttgctcatacatttcaaatctttgcccctgcctacaccccgcaaccacacacacacacacacacacacacacacacacacacacacgtgcgcgcgcgcccccgccccccccagcccctgacccccccaggtcttagaagcctgcagtggggaaagtctcttccttgtttcacctccgttcttacttaccttgctgctgtttttttggccctttcggggtctagcctaccaggagaggggcctctgagaaaaagtgcacagaatgggtgatgagactataagctggagttggggcactgtgggcttatgcttttgtgtattctttgggagctcccccacttgtagtgactcaccatgggcaacgccttctctagcctgcttccttccacctcctggtttccaaaaaccaatccctctcttggcaccccctcctcccttcctgccttctcaggccagtgccattcctagtgcccatcgagaggcatgctcactttaccttgccaaagctttgcctcaggctcagccacctttcattttcaaggcaggagtcagcctctacatccttcctaattccagaagtcacaaaccaagtgcccctttagaaagatttccttgaggacctcctccctcacctcgcacccaacacacctagacagcctggctctcaagaaatccttctcatgagcctcttcaatgtcctgaatgccaaaccagttctcaagggttcatccgtcaccacctcctggctacagataagacaaggctatttgtgagatgacccaataccgcactctagagagtgggatttgagtatctatcgttctcagtttgggggcctttggcaacactcatagataggaagagtcctgtttaacaactacttagacaagcaaatgcccagggagactgtatcacccacaatggcagccctcatgttccatctgaaggctggcaggctggctatgccttctcaacactggaatccccaggcctcatcctgagcttgtcattgcttcctggatggacgttaatctccatgaaagctctgcattctgagtcccctagtttgtagaggaaggcatcaggctgacaatgtcctatgaacttacttggggggacctacgggtcctcctttctacctgctgcacctttgaagaaaaaagcccaatacttggtgcagcctgggcacattctgatgaactgccagcctgaaatcagaacatattgtctgccttacagaaggggatgcaatccctgattaagatccctactgggacttccaaaagggaggtagagtgaacacaagagccacatgataacttgcttcattggagggatgaaaaggtgtgttgttcagcctattaattatgaaaaagtcagagaaataacagagaaaagatgagaatccagccctcttccagggctgcttggtggaggcctttaggaagtataccaatattaatcctgataccccaaagggtaagttctaataaatacccattttttcattcaatccaccccagacattaggagaaaactatagaaggcagctaaatgaccacaaacccctatgaataagctcacagacttggcctttgaagtactgtagagatagggttgaggaggcaaagagagttcaagaacaacaatgaaaggcacagtgcttggcggcagctctagcctctgtaccagctcaggtttaccctcccttgagaaagcccatggcaggggcaggatctagaaagtctggttcagactgtcctgctgagaagagacctgttttaaaaatgcagccagggagttcctgttgtggtgcagcggaaaggaatctgactaggaaccatgaagttgcaggttcgatccctggccttgctcagtgggttaaggatccggtgttgctgtaagctgtggtgtagattgcagacgtggcttggatctggtgttgccatggctgtgacataggccagcagctgtagctccgataagacccctagcctgggaatctccatatgctgtgccatgggtgcctccctaaaaagaccaaaaaaaaaaaaaaaaaatgcatccaggaggggcactggaaggaagaatgtctcctgcatggaaaaaatccattgatgtgcaaacaagagggtcacctgaagtgggtcttcttgcccagtcctgaaggggacttggggtcaagaggactgaagactgacggggtgggaccctccctggctcccaaaggatacctggtcaattccctggagaagcctcaggtaacccttgatatggcaggtgggaaaattattttttttaagatatgggggctgtgtactctgtgctgaatggggatccttgccccctatgggatcaatggacagcctgatgccaaatgactcacccaccttctacctcctcagctgtttaccaggaagttttacctttgtatacaagtttctgctcatgagtgcccttgttgggaaggtttttgctttctaaattccagacaatagctcagtttggagactccctcagagaagcacccaccaggagaaacaattgctcttggccataggagcctgcctcagtcacaaatgagaagaggtctccctccaacccaaattttttcctcaagtaaacccctctgtgtggcacactgaagatcctggcacagctactattcagatttcactaaaatccagtgctgatgacttgtggaataaacagtatcccttggcccaaagaggtatccagcctttaataacaaagttcttaaaatatgggctagtacaacctggccagtctctgtgcaataccctcattctgcccataaaagagcaaagtggagaaaacacatttgttcaagacccaaggccagttaataaggcaatagtcccagttcacccaatagtccctagtccatacactatactgacccgagttatggaaaatacaaaccggcttaacaatgcttgacttaaaagaaaccttcttttgcatttctctgctcagaccatcaatatctcttttcctttgagtggtcagatcagacactttaacacttctcagctagtctggactgtactgccctaaggcttcagggacaccccacacctgtctggaaatgtgttaacaaaggaataaagagcattaaggttggtttatgggtctctcctatagtatatggatgacctcctaatttttagctccactagggaagactcagattaaaaataccattcaggtcctcatcttcctgggggaacaaggatactgaggtttctcctcacaaggcccatatctctacccaataggttaagtacctgggatacttgctcacccctggaacaagaactccggcctaggactgaaaagaagccatcacaaccccttgacacccctgccacccagactaagaggtaagataagacctttctggggatggcaggattttgcaggatctggatacctggattcaggctcatagcaaagcctctctgaggccctaaaaggaaagactacaagctgctcaagtgggatgaaaattgccaacaggcatttctacctgttgcatctgctcaccccaaatttactattcattgaactccctccctcccctaaccctggcaaccacaatctcctctctatatctgtgagtctgtttctgttctgtagataggttcatttctgccatattttaattctgcatataagtgatatcatatggtatttgtccctctctttctgacttacttcacttagtatgagaatctctagttgcatccatgttgctgcaaatggcattatttttttcatttttatggctgagtagtattccattgtgcatatgtaccacattttcttaatccatccatcaatggacatttaggttgtttccatgttttggctattatgaatagtgctgctatgaacatacaggtgcatatatctttctgaattgtagttttgtctggatatacgcccaggagtggaattgctggatcatatggtagttctgtatctagttgcctgaggaactaccataccgttttccatagtggtacattcccaccaacagtgtaggaaggtttccttttcttcacaccctctctagcatttgttatttatagactatcaatgacagccattctgacctgtgtgaggtgttaccttattgcagttttatttgtatttctctaataattagcaatgttgagcatcttttcatgtgcgcaggcgtaactcttaaagtttgccaaatcctaaagccagtcactgtaatgctgggcccccatgccaagggtccttggttcatttctgtgtggcaactgttgaataagtatactccagtaggccagacctcaaggatgggtccctggccaatcccaatgcagtgtggtttaccaatggatggaaacagtttaatacatgaaggactaagaaagactgactgggagtccccatcgtggctcagcggttaacaaacccgactagcatccatgacaattggggttcgatccctggcctcgctcagtggattaaggatccggcgttgctgtgagctgtggtgcaggtcgcagacatagcttggatcccgcgttgctgtggctgtggtgtaggccaacagctacagctctgattggatccctagcctgggaacctcatatgccacagggtatggccctaaaaagacaaaaaaaaaaaaaaattataaaggctgactctgccattgactgtggtcaattgttgaattgagagttctatcctctctcagtaccacccaaaaggccaatttgatttgtcttgaccagagcactccagctaggaaagggatgaagaatcaacatatatactgattccaagcatggattactagtgctgcatgccatactgccatatggaaagtaaggggactactaacagtcaaaggatcccctatgcagaaattctagaactcccagaagcagctcagaagttattcattgcagaggtcaaccaaaggggcaacacctcccttataaggggaaacaccctggctgacaaggcgctaagactacagccaaagaacagccagtcctacaagctacagctctcagacttaacagctcaacattcccagtggtgccatcttatacacctgaagaaattgagtgggctgagcttaggggacagggaagataccactcagggtgcctgacaaaagacagcaagcttctcattcctggggcggagcaattgaaaataattaagcacttccctggatcctcccactcagggcaggactccctagtcaacctggctactcaggtgttcctgggtaagggatggtcccaaacttaaaaatgtcatcagggcttgcgagatgtgtgcctgcagtgacctaggaagccacaccatacctcaacatctgactcagcccaaccaacatctgggaacttatccaagggaggattggcaatggatttgacccaaatgcctccacataagagatggaaatacctatttgtattcatagacacttttacagaatggatagaagcttttcctgctagaactgaaaaggcaatacaagtatccaaatttctgcctaaaggaaaaattctgagattcaggttacccaaaagcctacagaataataacagaccttccttccctgccaagatgacatgacaggtttcctcagctctgggtataaactactacctccactctttctggaggccccaaagtagaaaaagcaagtcatgttctaccaagagcatttgctaatctgtaccaagagacttcagaaacctgggtttcccttcatgaaccaagacagctccaaagggaattttaaaactttatccatttgaaatgacctgtgggaggcccttttggacctcagatctcttgcttgatgaggaaacccacaaattggtctcccacattgttaacctgagccaagttcaaagggtcttccaagaatatgggaacaaagtgctacccttcctggccaaaaagaaaatgtcaaggtctccatccattcagggtcctctaaaccttggaaagaaggatcccctgtggagcagccacgaccaaaatggaagggaccatatcaggtgacactaagaaccccaactgctgttgggctacagggagttactagttgggtacatctgtctaaaataagtcctgtacctttaaagtcctaacaagaaccagaagagacctactcctgtgagccagtagaagatttcaggcacctgttcaagagaacagataagtgacttcacatagctctggtgggtgggcctagtaaaccttatgtttctaactatcatggtcttattctgctgcttttcagaatctcctcctctggtaaacatcttctttgctcctgctgggtctgataaaaaagattgcattatgttgtcaaaaaccatgatactcctagaagggcttctgatgatggtcatggctcaagaggaacaggaaaaaattctttaataaatatatttaaaatcattgcccagggagaaaaactagttaattgctgggtcttccataaaaaccctggcttatgacaattgttacaggtacaaagaggtatatgaaagaattttaccaactgcaacacatggaacagctcctcagcgccctcagcgcccctcagctaagaaaatgagcaccgtgggcacgacccagtcaaacccagcacttggtctgcattttaacactccaccccctttttaaaaaaaggtgacataactttttcattaatcatgttacttttgttattcagaaaaccagtcgtgcttccaatgccactacacctctaaaggggcttgaggcagcctcttcggagcagtcgctgaccaccagatggtaatgtcaacacattgtcttggaacccagatccaaactacattcccacaattgtctccactctgtgtgcttataatgaagcctagaccaaaggtgactataggatagggatgtaatggactaaaaattggtcttaaaatgttcaggctctagagaagcagtggatataaccttcttcaccatcttatctaagtcaagggcatggaatactggacttaagtattttgaatacatgaattgtgttcacagcttgtcccttccctggatctggatggctgcttccttgttaaattcttttcttcccagatctcttacagtaccttcaggatatatgtgggtataaggcactccccagaatgcgggcccaatgacaaatgcaccccagggaaaatgtggaccctgtataaatgtttctccttatattgacaatgtatggtgcaagggagcctgcatatgacgatgtctggccgcgctcacagtcacaatacacaataatactcaatacccgttccaggagggccactggattaacactggcaggaataggaatggaaggggaattggcagccccaaggggaggctttgcccaccgtgaagtaatcccagaaaatctaaccaacactttagagagctgagctctgaccaccggaaatgccctctatagactttcaacttctttaaacttaatggccagtgtggccacaagcaagagatcggtcttagattacttgctggttgagtagggtggcatttgtacagtcataaacaaaatctgctgcacctatgttaataattcaggctggatcgagatggatatcaaaaagctttatgaacaagcatcatggttacaccactacaactagggcttagacactaatgccatctggtcctccattaagaatgccctccctaacctcactcagttcgtgcccatcctgggcctgagtcctcttcctcctcttcagactctgcttctttaacctcttgggaaagtccgtgtcctccaggttactacaattccatgtcagaatgatggctatgtgaggactccagcctatgctgccctctgatttaaaacaagaagctgtcttgtccctgcagcccctagaccaagcacccagagatccctgtcaggcagagtcgatgcccctgcccagctctgaagcagctacagaagatcaaccatcgctcctctgctacccataaacatatgggaataaaatctctgtgtgggagtgggacaggaggggaaggggcagaac

SEQ ID NO: 201 - DNA, 10908 bp, artificial
  ss1784 sequence
tgtaatctgttgttcattatgcccatattataataaattagtcatgcagataagaagtacccagcatgtacggacagcgtgacacttccaatcaaagttaaataaggacaaaaatccctcttccctttgggaaggtggagctagaatgacaatcagggaatatgacctccaaacccctccttcccaatgaatatcctactcattcatttgaatgcccttcataaccttcatgccaaagaaacacagggcaggtgcctgggtccctttaagaagtatatttctcacttaaataaatcttcacgttattttctcaatttgtctcatttctgaatttcttcggcaacaagaacccctccccacagcttacaggtttcttgcctgactatccttgtctccactatacagccctctctcttttactttccactcttattttgtgccttactctgttggagacggaggcaaagaaatctgccaggttattttccaacatttccactaggtctttcacttcctacagtcataaataggcagggcatggcaggtaaagtttccagccatcctcgtgggtacctagggactggagctgtaagaactctgtttctgggtttgccttattcacctctggattgcccgatagcaggtccaattatgtaaaaatataaaatgcaggagttcccgttgtggcgcagtggttggcgaatccgactaggaaccatgaggttgcgggttcggtccctgcccttgctcagtgggttaacgatccagcgttgccgtgagctgtggagtaggttgcagatgcggctcggatcccgtgttgctgtggctctggtgtaggccggtggctacagctccgattcgacccctagcctgggaacctccatatgccgtgagagcggcccaaagaaatagcaaaaaaaagacaaaaaaaaaaaaatgtatatatatatatataaaatgcaaccttagagtgtgcaccatggctgcagcttcaagagctccctcttgtgtgtgtacccccaaggatggggaaggagggaacggccctgtgctgtgcggttggactcatggtgtgggaccgagtctgggccaccaccatttgcagatagccccagacacggcttggcattgggttggcccctccagagtccaccgcacatctgtggtctgccctgcctccctcaccttggcagggaacgattgtgctgggtaggttgtgcacatggccaggcccaggggatcacaccttggctgcaacccactgctgctgccatcccctccctcttccagggtctgccatgcatcccaaggtctgtccctgctcccaccctcacctcaccctgtcagagctttgcagcttgtgctgtgggtggggtggggtggctggtacacatgacttcacccagggaatacatgcctgggtgtgacctgctgtggctgcccatccccctcctcatcacagggcttgcctcctctgggtcctatgtggtaagggcctctgtccctctaagtactgacagggtgcctctgcctttgttgccacactccctcccagtacccagccccactgcctgctggatggagtacatgtgggacagggtagaggggagggtggcaccaacaaaaaggaagggtaaggagaggcttttccactaatcatctccctttctgaccagtgcctgtttttagggacttaccaccctcgtagagaaagaaagctgggacttaaacagctcctataacaatgacatttccattccagggaacaaaccgcagaacaaagggttaatctatagagaagccttcaggcaggtcactcatcctggctaatgtggacaccaggataggacacaggccctaggatgctggggccagtagggttgccacacggggaagtagctgacccccactgtggctagggtcgacagcactagggggacaaggactactggaaccaggcctgtctcagggagcccctatgggacctcctaacactagtatccctgttataggagcatcctcgccctgaaggaatgatgggaaacacctcctccattcccaaggactcacccttccggggcattctgagtcaccgggacaagtgttctctagattctttaaaaagaaaaaagcttgtttccttttgcagtatatcctggtcccaatacaaacttgaggacgatgaggtctggccagaaaatggaagcctcaactataataccatcatatggctagatgtcttttgccagaagcagggaaatggacagaggttccttatgttcaagttttatggccttaaaggagaaccccgaactatgcaagccccatgttaggggaccttgctggctgagacccattcaggctataaaaaagcccactatagagccccctatagtgacagccctggaggaacaagagcctgagacagaagccccaagcccccttccccatcttcagcctctcccatgccccatgagcccctttacccttccttaccaaaagtgcagccagagcttctttgcccccttcagaaaatagtaggtgggcctcctggaattaatagagaccatacccctttttccttgtccaacctcaactagtgccacgctcgcttaggcagagtctcagaggaccctggctggtttgccaaagaattccagggactatttctctcacttgatgttacctggaaggacctaaatactgtcctttcccactgctgctccactggggaaaaacctgtatttgggcacaggctcgaaaatatgttgatggattacacactgctgaagttcatcaataccccgtgggcatgagagcagtgcctttgatggatcccaacggggactatcagccaggtcggcctggcatcattagagaggaacacatggtcctgtgccttactgaaggaatggaatgatgcttaattaaacctgttaactatgataaggttaaagagatcacccaaggccaagatgaaaatccagctctacttcaggcctgactggtagatgccctcagaaagtatatgaatatagacccactgctgaagggcattgtatttgcaacccactttatttgccagtcagcccctgacatcagtaggaagcttcaaaagcttgttgtggggccccatactcctctcaatcttatggacacagacttcagtgtctttaacaatggggaccaggccaaggaggaggaggggcggaggaggaggaggaggaagggaaagaaggacggtaagccaagcttttggcagccgtcatgacaagacctaacccactttctcgtcatcccaaaagtactcccagaaggctccgccaggagagggagcttgttacaactgtgggagtcccaaacactggagcaaggcatgcccaggaaacaggtcccagcctacacccaaaatgccatgcccactctgggacttcccaaggctcttgagaggacagtcatcatcacatgggaggaaccacaggggaccactgatgtggcagataagcttgtctacttcctagtggacacaggagccacttaatctgttctgacttctcacgctgggccccttgctcttgaaacctgctttattgttggggtagaggaagaccaaagccaaaacattttaccatacctctaacttgtgcctggggaatgactcttaaaacaagttcccgtcaggcctgcatgccctagcccattactgggaatggatttttctctcagccttgggggagatccttactctctctgaactccagagccaaggaatgcttttggctggactatgtattatacaagacatggaaatccatctcaaattattcccccagaaactgaaagacttttagagccacaggtctggaatcagggaatcccagggatggcaaagtttgtcactcctataaaaatcaccttaaaggagactaacgacttcccttccaggcgccaacacctcacaaagacagaggctcgacgaggcctccaagccctaaactgaaaattcatgacatatggactttcagtgccaccccagtctccccgtaacattccagtccttcctgtcctcaaaccaaatggggaatactgtgcgagatctccgaatcataaatgaagctgtaattcccctacagctaattgttcccatacacaatccttagtcagctccccgaggacacagcctggcttacagtccttgaccttaaagatgccgtcttctggatacctgttcacctagatgctcaatacctttttgcttttgaatggactgacccagacactaatgcaacccaccaatatacccggactgtccttcttcgggcattccaggacagcccatgcctgttcaacaatgccctagctaaggaatgaaatgaactaaaattagagacaggggtgttattacaacatgtagatgaactccttggctgcagcccctcacaggaagcttcagaccaaaatactgtacaggtcctcaatttccagggctccaggggatgtaaagtattccccatggaaagcctcaatttccttccagagtcacttacttgggacatgttctaagcccagggaagtgtgccctcaggacccaatgtaaggaagcaatcatccatttacaacaccacatacaaagaaacagctcagaacctttttaggaatggttgggtttagtctcacggcaaaatcatcatatgaggccttaaaggggtcagacagagaacttctagattggccagggaacttacaaagagcattcagtcagtttaagacaatgccccagggagttcccattgtggcacagtggaaacaaatccaactagcatccgtgaggatgtgggtttgatccttagccccgctcagtggatggcagaatccggcgttgccgtgagctgtggtgtaggtcacagaccaggctcggatcctgcgttgctgtggtgtaggtcagcagctgtagctccaatgccacccctagcctagaaacttccgtatgccatgggtgtggccctaaaaagcaaaaaaaaaaaaaaaaaaaaaaaaaaaaaaaggccccagccctgggaatcccagatcttaataagcctgttactctatttaccccagaaaaacagggaatagccctaggagttcccatcccaaaagtagggccaactctacgccctgtgacatatctctcaaagcaactggactcagtggccttgggatggccagactgtccaagagctgtagcagttagagcgcggctagttgacgaggccacaaaactcaccatgagtcaacccccggaagtattgactccataccaggtacaaggagcattagaaattaaaggacatcggtggctgactggaggctgctcacaaaataccaggccctcctagacgctcctgaagcaattcttaaagcatgccagagcttaaatccagccaccctcttgccaacagaaagccctgaggaattgtctcattcttgcactgagaccatcgaacaggtatattctagcagacctgacctcagggaccagctccttgatgttgtctggtttactgatggaagtagttctatacaggatggcatccggaaagcagggtacacaccacagtagatttgcatgagatcatagaggctgatgccctgcctgcccagacctcagcacaaaaagctgagcttagaaccctaactcgagctctaaggctaggaaaagacaagaggatcaacatctatatggattccaagtgtacatttttggtgtcatatgtatatgctgctatttggaaatacaggggactcctgaccacacagggctccccaatccagcactgccaggaaattttagaactcctagaagcggtgcaagaccctgaaggggtggcagttattcactgtaaggggcatcagaaggggaattcagacccaggaaaaggaagtcatctagctgacaagacagctaaaggtgcagctcttcaaccccttcaactgaggctgcccttacttccccacgtgccagcccccagcctgctttcgccactccagtaaacaaacacgaggggcaagtgggctagagccaggggatatcaaaagggccctgatggatggtagattaaggaacaaacagtaatgctgccccaagcattacaagggaaaattttaaaaatcactcccgactcttctcatctggggtgggatgctttgactagccttgtgggaaaagttttttctggtttaggccttcctcagactatcttagaaatgacaaatgcctataacatatgctaccataacaatccaggggtaaaacttaggcccctacccctccactagcccattcaaagaagaagaacttaccaggagaagactggcaaatagattttactggggggctaactccccagggatataaatacctcctagttttcactgacactttcatggggtaggtggaagcctttccaaggaggaccaagagagctcaggaagtagtcaaggctttattaaaagaaataattccttggttcagacttccgaggtctttgcaaagtgataacggtccctcttttgtggctaaaataacacaacaaatctctactgccctaggcatgtgctgtcatctccatgctgcatggaggcctccatcatggggaaaagtagaaagggcagatcaaactttaaacagaaccctggctaagctttgccaagagacatcagaacctctgacaaaactttacccatgccctcctgagaaccagggtggcacctaaatcagggataaaggtcagccccgttgacatgacttatgggaggcctttcttatcctctggtattctagcagactctgaaactagtgagcttattaagtacctaattaatctggaaaggtcctaaaggtgattttagaatatggaaatcgggttttgctggcccccagccaggaaaaaggccctattcaggttcagctgggagattctgtgcttctaaaaacatggagggaagggtccctctctgatcaattactgcccaagtctaaggggtcctaccaagtccttctcagcactcctactgtagatcactagttgggtgcacctttctagaattaaacctacctctccccctgagtcttcacaggacaaggaggaccttgggtagccaagaggagtccaggtggacgagtgagccttttcaggacccgaagctttcattcataaaggacaaagaaatgtcacagatccaaggctgagtacctatagccactattttcctttttactttccaataccctagtccacccacagaatagctaatttgctctggtggatttggttccttattattctccccgcttccctctcgctgctgcagtctttcatgagtgccactacagcctggcacctataccccagaaggaactcctctgtccatgctgggtgtgttaggacctgtcccaaacctgaaaagacacccccagagtctctaacctttttcttttctgcttccaaaacatgttcctatccctgctcttactggttcttgtcttatctatccaatctctttggtcccaagacttaacatggaaagataatctaatagttagtaactcctatattattcctaaaggggaaataaatctctcttgctgctgggtttgccatccccggcccaacaccccgggagacgaaagtaccacccccaaagcctacccagtcactggcaatgctctattctcagcctttaaccaatcttcttttaattactctaggcaaaatttttctttgttacatggaaaaggccacctcccctctgttatcatattatacatccctattcaagggctatatataccaccaagacttccccaatctgcaatcaaaccctaggatgcaccccttgtcacaatactcacaagggaaatatggacaccttttcagccctcgaggctctgtctaacagaaacctaagcttgcccctagccatctttcagcctataaattggagtgatatagtgggccagtctatttacactccatcctgagcccttaacaacacacatgtatgttatgaccgttcagaaactactgccaacagaacttcttgtgccacctgttacatcggacatccccttagcatgtccctcctgaatacagacaccctcctccaggacacgccaaaccagggaccaagtccaaaatgcagatgggacccctcagcaactatctcccacttcccagagcttttctccagctgtataaccaaatcacactgtcttactagcactgcctggattatcatggctatgtctgacctcagacaactacctgacaatgaccaaagcaactgctctctgacatctagataacacacttcattatggcgcctgcactctgggaactgtggctccagcacaaataactgtcctcaatgaaattcatgtgagacaaaaaagagccatggagttcctgttgtggcttggtggtagcaaacccgactggtatccatgaggactcaggttcaatccccaaccttgctcagtgggttaaaggtgttgccctgagctgtggtgtgggtcacagataaggcttggatctcacactattgtgtgttgccctgagctgtggtgtgggtcacagataaggcttggatctcacactattgtggctgtggcataggctggcggctgcagttcccatttgacccctggcctgggaacttccctatgccgcaccagcaaccctaaaaaaaaagagcctttggtctggttctggcagggaattatggggactatagctgcagctgcccctggggaggatttgcttatcacgaggcaaccttgagggaatctaacctcctccatggatagtgcactaaagaaaaccatggacattctcaaaaaccttacaaaaatccctagattccctggcaggggtagcctgtgataatcaccgagtcctagactgtgggacttcaaggactctttgaggaaacagaactcaaagcctctggccaagacaagaattaccagacccttatcatcgccccaccagtctcactataatgctccccccaccgtgagcaacctggccgactccttcctacccctactaggaaaggtatgtggcccactcctcaccctgccccaatagagggcttatatgcccaaccaacccctctttccccaaccaatcagcagatatatcataatacctctcctccccttgggctataaaaacagacatgaccacacatccagggtcagtgctccctgattgtcccgctgggctagccatgttccttatctcaataaactcttctttctcttcgccttgctatgagtctggaaaattctttttccaacttgcacacatggaccataacatagaccacctgctagcaagccatggaggggtttgtgctctcataaataaaacatcatgcacatatactaatgccacgagaaaagtaaaagtaaacattattatataaacaggcttcctggcttcacaggtataatcaggggaaacaagaatggactgagactgttaggggtggttcccaggatataccaggctcctcccattatatttctcatctttctctttggtccttgtacgtttaactgcctactgaaatttctattctctagaatacaactccagcttcaaatgatgctatgacagattttgacccatcccacccaaagatggggaccaacaatacccactgaacaggggtgctgcctccttttactccatactctccacctctgccactgtaaacaactccaagacctctatctctgacagacagcaaggagatctggacccacaggtagggacaatgcccatgctcagtttgaagcagatatagaagatggactgttggctcattttcctcttaaaagattttaagggtctagactccttgaggggggaaacattacaataggtagatagctatgtatgagtagagaaaggggtacgggggccaggtggcaggaaaccatgtatcatgcaaacagcagggtccatagacagacaaagaaaagcaggaatctctggactgacaggaaacaaaactttctggggtgataaatgcactggaggcaaaggaaggtggaaaagggtgcagatctccagcatccaaatgtaacctgttgctcattatgcccccactacaataaaaccagccatgcacataagaattatccatcatgcactgatgctatgacacttccaatcaaagctaaataaggacaatccctcctccctttgggaaggtggagctggaatgaaaatcagggaatatgactccccaaacaccaaatcctctccttcccagtgaataacctgctcattcatttgaatgcccccttaactagcatgccaaagaaacacagggaagctgctcatctctctgccttcctctctttaagaggtgtgcttttcacttaaataaatcttcaccttactttctcaaatttccatcacggttttttttttgttttttttttttggtctttttgtctttttcagggccgtgccctcagcatatagaggtttccaggctaggggtctaatccgagctacagctgccggcctatgccacagccacagccacgccagatctgagctgcatctgcaaactacaccacagctcacagcaataccggatccttaacccactgagcgaggccggggatcgaacccacaacctcatgattcccagtcagactcgtttctgctgggccatgacaggaactcctccacctcatttttgaacttcttctgtgacgaggcaagaaccttcctttctagaacagtatgtctttggttattattgagcagagatattatccaaatccagttctttcacatccaagccaaggacttcctggcagatgtctagttttgttcaagatca

SEQ ID NO: 202 - DNA, 5890 bp, Artificial
  ss1791 sequence
  misc_feature (4505)..(4604): n is a, c, g, or t
tgtttccacctcagtcttcaaccaatccaaagatttctgtgtcatggtccaaatcgtcccccgagtgtactaccatcctgaggaagtggtccttgatgaatatgactatcggtataaccgaccaaaaagagaacccgtatcccttaccctagctgtaatgctcggattagggacggccgttggcgtaggaacagggacaactgccctgatcacaggaccacagcagctagagaaaggacttggtgagctacatgcggccatgacagaagatctccgagccttagaggagtctgttagcaacctagaagagtccctgacttctttgtctgaagtggttctacagaaccggaggggattagatctgctgtttctaagagaaggtgggttatgtgcagccttaaaagaagaatgttgcttctatgtagatcactcaggagccatcagagactccatgagcaagcttagagaaaggttagagaggcgtcgaagggaaagagaggctgaccaggggtggtttgaaggatggttcaacaggtctccttggatgaccaccctgctttctgctctgacgggacccctagtagtcctgctcctattacttacagttgggccttgcttaattaacaggtttgttgcctttgttagagaacgagtgagtgcagtccagatcatggtacttaggcaacagtaccaaggccttctgagccaaggagaaactgacctctagccttcccagttctaagattagaactattaacaagacaagaagtggggaatgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgacagccctagtgacctatctcaactgcaatctgtcactctgctcaggagcccacgcagatgcggacctccggagctattttaaaatgattggtccacggagcgcgggctctcgatattttaaaatgattggtccacggagcgcgggctctcgatattttaaaatgattggtttgtgacgcacaggctttgttgtgaaccccataaaagctgtcccgattccgcactcggggccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgagggggattgttcttttactggcctttcatttggtgcgttggccgggaaatcctgcgaccaccccttacacccgagaaccgacttggaggtaaagggatcccctttggaacgtgtgtgtgtgtcggccggcgtctctgttctgagtgtctgttttcggtgatgcgcgctttcggtttgcagctgtcctctcagaccgtaaggactggaggactgtgatcagcagacgtgctaggaggatcacaggctgccaccctgggggacgccccgggaggtggggagagccagggacgcctggtggtctcctactgtcggtcagaggaccgagttctgttgttgaagcgaaagcttccccctccgcggccgtccgactcttttgcctgcttgtggaagacgcggacgggtcgcgtgtgtctggatctgttggtttctgtttcgtgtgtctttgtcttgtgcgtccttgtctacagttttaatatgggacagacagtgacgaccccccttagtttgactctcgaccattggactgaagttagatccagggctcataatttgtcagttcaggttaagaagggaccttggcagactttctgtgcctctgaatggccaacattagatgttggatggccatcagaggggacctttaattctgaaattatcctggctgttaaggcaatcatttttcagactggacccggctctcatcctgatcaggagccctatatccttacgtggcaagatttggcagaagatcctccgccatgggttaaaccatggctaaataaaccaagaaagccaggtccccgaatcctggctcttggagagaaaaacaaacactcggccgaaaaagtcgagccctctcctcgtatctaccccgagatcgaggagccgccgacttggccggaaccccaacctgttcccccacccccttatccagcacagggtgctgtgaggggaccctctgcccctcctggagctccggtggtggagggacctgctgccgggactcggagccggagaggcgccaccccggagcggacagacgagatcgcgatattaccgctgcgcacctatggccctcccatgccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaatttggctaaggtaagagaggtgatgcagggaccgaacgaacctccctcggtatttcttgagaggctcatggaagccttcaggcggttcaccccttttgatcctacctcagaggcccagaaagcctcagtggccctggccttcattgggcagtcggctctggatatcagaaagaaacttcagagactggaagggttacaggaggctgagttacgtgatctagtgagagaggcagagaaggtgtattacagaagggagacagaagaggagaaggaacagagaaaagaaaaggagagagaagaaagggaggaaagacgtgatagacggcaagagaagaatttgactaagatcttggccgcagtggttgaagggaagagcagcagggagagagagagagattttaggaaaattaggtcaggccctagacagtcagggaacctgggcaataggaccccactcgacaaggaccagtgtgcgtattgtaaagaaaaaggacactgggcaaggaactgccccaagaagggaaacaaaggaccgaaggtcctagctctagaagaagataaagattaggggagacggggttcggaccccctccccgagcccagggtaactttgaaggtggaggggcaaccagttgagttcctggttgataccggagcggagcattcagtgctgctacaaccattaggaaaactaaaagaaaaaaaatcctgggtgatgggtgccacagggcaacggcagtatccatggactacccgaagaaccgttgacttgggagtgggacgggtaacccactcgtttctggtcatccctgagtgcccagtaccccttctaggtagagacttactgaccaagatgggagctcaaatttcttttgaacaaggaagaccagaagtgtctgtgaataacaaacccatcactgtgttgaccctccaattagatgatgaatatcgactatattctccccaagtaaagcctgatcaagatatacagtcctggttggagcagtttccccaagcctgggcagaaaccgcagggataggtttggcaaagcaagttcccccacaggttattcaactgaaggccagtgctacaccagtatcagtcagacagtaccccttgagtagagaggctcgagaaggaatttggccgcatgttcaaagattaatccaacagggcatcctagctcctgtccaatccccttggaatactcccctgctaccggttaggaagcctgggaccaatgattatcgaccagtacaggacttgagagaggtcaataaaagggtgcaggacatacacccaacggtcccgaacccttataacctcttgagcgccctcccgcctgaacggaactggtacacagtattggacttaaaagatgccttcttctgcctgagattacaccccactagccaaccactttttgccttcgaatggagagatccaggtacgggaagaaccgggcagctcacctggacccgactgccccaagggttcaagaactccccgaccatctttgacgaagccctacacagggacctggccaacttcaggatccaacaccctcaggtgaaccgcctccagtacgtggatgacctgcttctggcgggagccaccaaacaggacgctagaagaaaggatcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataggatacaaattctttgttctgaaaaagtttaaagtattttaagggtattataaaaattaatattcataatgcatattaaaatatttgagatttttacagccctggtgacttaggttgctagaagtgccaaaggagttttctccactttttttttcaatctgtcattaattggtgctgtttattcacagaactgtcttcctttggagtcaccacctgcagtaacttattatagattcttcagttccattattcatatttgtgcttctgcatctagataccaccctactgtcatccactttatgtgccacatggtgcttagaacttgctaccatcaaatgttgcaaaataaaacaggtatcccatttatctaaagtttatacaatttgacgtgtctcacgtaaattggagaattctgacttatttggtatataaaagttaatccctgaaacataaaactgactagtaacagccaagagtgtgtcattagtgtgctttataaaaataattcccattataaagggatggaagtattacagaagcctactgaataactagtctttgttaaccacattgtctggcatatttattggagtcacatcaggtatatgtatttaccaaatcttctcaaatcttttcaaacactcattttgcaaagtttagctatttctaaatccacccttagaaaatgtctttatatttggcaatcctttaaaatagttacattttctcctcatacagtaaattgaaaatacattgaagctttgagttaaatttggtacttgtgagcaaactttcctgtaagaagttttttgagttctccattcaaaaaaatttaattgcaaacatttcagtagatcttcttatagaatggcatcatgtaattaaatatccaaacatgaaccttaaagaaaggtctagagatgtcccattgacctaaattctaatgaaatcaccaagataataggtgaaattgactgcattgacaggattataatgacatgacaggattataatgacaaatacttggaaacagaaatgtccatctgattttcacaagttcatttagctctattagacactatttgattgttccccagaattttgtgagccatgtcttctaagaactgattcccagatacttgagtgagtaaaacaagataaatgttttagagtctattctctttgatcaccatcaagagataatgacttttctgaaaaagatatttttgagttttactaacttgttttgatagttgaacactgtactatagggcctcagttt

SEQ ID NO: 203 - DNA, 5087 bp, Artificial
  ss1806 sequence
tggcgcccaatgtggggcagataggcaggcaggaggaccgaaggaccgcaactatagcagaatttttattcactggaagtgctgtggagccctgagaagaagggaggaatttcacatggccacgctaaagaaatcctgcagatatgttccctctctcaggtatttacggggtaacatgggaaataaggtaattgcaggaagctatagtccatacatttgtttgttaggggagcacaaaaacaagtgaaagtaagcttttggaactttttcagactattgagaaacattgtgattggtttcttacattagaaacgttagatttaaagatatgggaaatggtaggaagggaacttaggatattccatgatgagggggttccaattcctgtgtccatttggactacttggagcttaattaaatcagttttagaacctctacagaccacggcggacttagaggaggaagaagaaggggagtttacacctttgttggaggaagctaaatatgcagtccctgaataaaattgtcatagagaatatttggctcctgagccttcggttccaaattttgattttgatattcctccattgcctcctattaggagtgaggtgatgaggacgcatcaagcctctacttctaaggtggtaaagaaaatgagcactatccctgaacaccatctagcatccattcaacagggaattttacaggctcgaagggaaggcgatttggatgccatacatttagcctttccagtaactgtcagggagacactggctccaggcattgattcccgccaaccctggtggagtttatgtgttcattcatgagcctttccttttaaaattcttaaagaattaaaacaggccattcgaaactatggtgttaattctccctttacaaaaggaatcatgcagggagtagctaaaggaatcatatgattcctgctgattggcataacttaacccgtgctgtgctatcgcctagtgaatatttgcaatttaagtcttggtggcaagatcatgcccaaactactgctaatcgtaatcaggctcgaaatcttccaattacgacgtaacaatcgttagggattggcccttggagtaatcttcaagatcaaatgagaatgaatgatttggctattgaacatattagccaatgttgtttaatggcatgggataaaattgaatctaagggtcaaaaaaatacttcttttcaaaagatcctacaaggccctaaggaaccttatactgaatttctacctcttttacaagaggcattaaaacgacaaattgctaactctgaggtgtctgatactatttttcaattgttagcatatgagaatgcaaatactgattgcaaaaaggctatatgatttttaaaaggaaaagctaacattgctggatatattaaagcctgtcagggagtggggatggagtcctttaaggcctcaatgctggcccaagcaatggctaacttaaaggttaaagacaaattttcagaaaaatgttttaattgtgtactaaaaaacaatgttgggctcctcctcaagcccaaccttccttcctttcacagagctttggcaccttctagtaacaataataaacagcccagattatgtccaagatgtaataaggaaatcactgggctagtcagtgccggtccatctttcataaagatggatacccccgtcgggaaactctccttggggcgagcttccagccccgtcaaccaaggaagctctccctatccaaaacaagagccaaactctcaactgatgcgagattccctgggaactatgctctgcaggagctttcggcttcacagtagatctccctagattacaggatttaattctccttcctagtgaaactcctacttctattacaaccgaattggaaataccattgccaacagatacagtaggattaataataggaagggcagagctaacagaacaaggagttcgagttcatccagagatattggataatataggggatgataaagtacaggtgatggtttccactgcgattccttggaaaattaaaaagggggatcagattgcccagatcttaattttacctagagtacagaagaaaaaagagaggaataattttagacagaagggattcaataccacaggagggacaggagtgtttttatcagaaaaggtcctagaggaatgccccacttgtcaagttatcataaacaggaagtcttttaggggattgattgacactggggctgatgttttgatcattagccatttacattggccagacacctgacctcttcagccagcccatattgaagtcactgggttaggaaaagcagagggtctcaaaaagagtgcccaatggcttaattgtgaaggaccagatgagcagccagctagattaaaaccttatgttgctcaactccctatcaatctatgggggagagatttattacaaccgtggcatgcagaaattgacataccaccagtagatcaatacagtcatcaaagccaaacaatgttacaaaaacagggttacattcccggactggggttggggcgacatcatcagggaagagtggaacctgtagcatctgagattaaaatggacaaatctggtttgggacatcggccttttcattagtggccactgcttgtaaaaataattattcgattaaaatggactacagaaaacctggtttgggttgagcagtggcctatttctttggaaaaattaaaggttttaaatgatcttgtccaagaacaattagagaggggccatatagaagaatcctttagtccttggacttcaccagtgtttgttatacagaaaaaatcaggaaaatggagattgttaacagatttaagaggagtaaatgctgtaattcagcctatggttgcccttcaaccaggcatcccatctcctagtatgataccagctgactggcttttaattatcctggacttaaaaactgctttttcacaattcctttacacccagaagatagggaaaaatttgctttttcagtgccagtgataaacaatatagcccctagaaagcgttatcaatgaaaggtcctgcctcaaggcatgttaaagagccctaccttatgtcggtatcatgtggcttcagttgttgagccagttcaacaacaattttctaaatgctatattgttcattatatggatgatatactttgtgccacaccctctcgggagcagctgactgaggtttttcaatgcttgcaatcctgtctaaagggagtgggattgattattgctcctgaaaagattgaaatgaaaagtccatatcaatatctgggaactgtggttgaatgtgccactgttcaccctcaaaaggtagaattaagaagagataaaatttctacattaaatgatttacaaaaactattagaggagatattatttggctccaatcttgtttggggattcctacatgtggattgtcaaatcttttatccttacttaggggagattctaaattaaacagcccccgctctctaactgcagaagcagaagaggaaataaaaaaggttgaaagtaaaatacaaaactcccaactaagtcgggtcaatctaaaacaacccattcagttagtaattataccttctcctcactctcccacgggaatattgatgcaattagaaaatattcttgagtggctttttcttcccaatgatgtcacaaaatctttgtctctgtacctggacctgacggcaaaacttattctaaaaggttgtacttgtgtacaaatgtccagaaaagatttgaatcatgtaattgttagtttaactgttaaggaaatccaaaattgttttcaaaaccatataggttggcaaattgcctttgcagattacgtaggatcaatagataatcactatccaaaaatccctgttttacaatttataaagcgtactcaatggattctgccaaaaagggtgaaggagtcacccatcattgacgcccctgtgatctttactgatgggactagtaaagggaaggccggatatgtggctaatcaatctaaaattataagaacacctggcctttcagcccaacaggctgaactaactgctgtaatccatgccttgagggattatcctgagcctatcaacattctttctgattcggcatatgtagttcatactgccaaaatgattgaaaccgctactattaaacaaaatttacctatcttgttatttgacttgtttacagaattacaaactgctgtaagggaaagaagatatccattttatattactcatatcagagcacatactaacttacctgggcctctagttgcaggaaataaaaaattgactgcctggtgacaccagtgttacaggaagctcagcattttcatgatttaacacatgtgaatgttcgagctcttaaaaagagatttggaataacatgggctaaagctaagacagttgtctgtcaatgtcctgcatgtcaaattattaacaatccttctcaatctgagcctggagttaaccctaggggacttgtcccaaatgctctctggcaaatggatgttactcattattcatcttttggaaaattgtcatttattcatgtgtgtattgacacttactctaaatttatttgggctaatgctcaatctggtgaatctgctaaacatgttatttgtcatttatatgccggttttgcagttatgggcctgccacaagcaattaaaactgataatggtccagcttatatcagttctcagcttaaagcattcctagatacatggcatattgctcactctactggtctcccttacaaccccaaggacaggctattgtggaacgagccagtttatatgtaaaacaggctcttcaaaaacaaaaaaaggggagacacagaaatagttaagtcacaacaaacacttttaaataaaaccttattcactttaaattttttaaatttggcctctgatgaaaaaatggctgcagaaagacattttaatacagaatgaaataaggttaactttcctcaggctgaacagcccttgatttggtggcaggatccattaacaaatgtctggtcccagggaaatgtatta

SEQ ID NO: 204 - DNA, 8560 bp, artificial
  ss1833 sequence
tgaaaggatgaaaatgcaacctaaccctcccagaacccaggaagttaataaaaagctctaaatgcccccgaattccagaccctgctcgctgccagtaaataggtagaaggtcacacttcctattgttctagggcctgctatcctggcctaagtaagataacagggaatgagttgactaattgcttatctggattctgtaaaactgactagcaccatagaagaattgattacacatagaaagccctagtgacctatcttaaatcgctgcccggaagcctacgcagatgcggacctccggagctattttaaattgattggtccacggagcgcgggctttcgctattttaaattgattggtccacggatctcaatattttaaaatgattggtttgcgacgcacaggctttgttgtaaaccccataaaagctgtcccgaatccgcactcggggccgcagtcctctacccctgcgtggtgtatgactgtgggccccagcgcgcttggaataaaaatcctcttgctgtttgcatcaagaccgcttctcgtgagtgatttggggtgtcgcctcttccgagcccggacgagggggattgtacatttactggcctttcatttggtgcgttggccgggaagttctgcgaccaccccttacacccgagaaccgacttggaggtaaagggatcccctttggaacgtgtgtgtgtgtcggccggcgtttctgttctgagtgactgttttcggtgctgtgcgctttcggtttgcgctgtcctctcagaccgtaagaactggaggactgtgatcagcagacatgctaggaggatcacaggctgccgccctgggggacgccccggtaggtggggagagccagggacgcctggtggtctccttctgtcggtcagaggaccgagttctgttgttgaagcgaaagcttccccctccgcggccgtccgactcttttgcctgcttgtggaagacgcggacgggtcgcgtgtgtctggatctgttggtttctgtttcgtgtgtctttgtcttgtgcgtccttgtctacagttttaatatgggacagacggtgacgccccccttagtttgactctcgaccattggactgaagttaaatccagggctcataatttgtcagttcaggttaagaagggaccttggcagactttctgtgcctctgaatggccaacattcgatgttggatggccatcagaggggacctttaattctgaaattattctggctgttaaaacaattatttttcagactggacccggctctcatcctgatcaggagccctatattcttacgtggcaaaatttgacagaagatcctccgccatgggttaaaccatggctaaataaaccaagaaagccaggtccccgaatcctggctcttggagagaaaaacaagcactcggccaaaaaagtcgaaccctctcctcgtatctaccctgagatcgaggagctgccgacttggccggaaccccaacctgttcccccacccccttatccagcacagggtgctgcgaggggaccctctgcccctgctggagctctggtggcggagggacctgctgccgggactcgaagccggaggggggccaccccggagcggacagacgagatcgtgatgttaccgctgcgcacctatggccctcccatgccgggaggccaattgcagcccctccagtattggcccttttcttctgcagatctctataattggaaaactaaccatccccctttctcggaggatccccaatgcctcacggggttggtggagtcccttatgttctctcaccagcctacttgggatgattgtcaacagctgctgcagacactcttcacaactgaggagcgagagagaattctgttagaggctagaaaaaatgttcctggggccgacgggcgacccacgcagttgcaaaatgagattgacatgggatttcccttgactcgccccagttgggactacaacacggctgaaggtagggagagcttgaaaatctatcgccaggctctggtggcgggtctccggggcgcctcaagacggcccactaatttggctaaggtaagagaggtgatgcagggaccgaacgaacctccctcggtatttcttgagaggctcatggaagccttcaggcggtacaccccttttgatcctacctcggaggcccagaaagcctcagtggccctggccttcatagggcagtcggccctggatatcagaaagaaacttcagagactggaagggttacaggaggctgagttacgtgatctagtaaaagaagcagagaaggtgtattacagaagggagacagaagaggagaaggaacagaggaaagaaaaggagagagaagaaagggaggaaaggcgtgatagacggcaagagaagaatttgactaagatcttggccgcagtggttgaagggaagagcagcagggagagagagagagagagtttaggaaaattaggtcaggccctagacagtcagggaacctgggcaataggaccccactcgacaaggaccagtgtgcgtattgtaaagaaaaaggacactgggcaaggaactgccccaagaagggaaacaaaggaccgaaggtcctagctctggaagaagataaagattaggggagacggggttcggaccccctccccgagcccagggtaactttgaaggtggaggggcaaccagttgagttcctggttgatactggagcagagcattcagtgctgctacaaccattaggaaaactaaaagaaaaaaaatcctgggtgatgggtgccacagggcaacggcagtatccatggactacccgaagaaccgttgacttgggagtgggacgggtaacccactcgtttctggtcatccctgagtgcccagtaccccttctaggtagagacttactgaccaagatgggagctcaaatttcttttgaacaaggaagaccagaagtgtctgtgaataacaaacccatcactgtgttgaccctccaattagatgatgaatatcgactatattctccccaagtaaagcctgatcaagatatacagtcctggttggagcagtttccccaagcctgggcagaaaccgcagggatgggtttggcaaagcaagttcccccacaggttattcagctgaaggccagtgctacaccagtatcagtcagacagtaccccttgagtagagaggctcgagaaggaatttggccgcatgttcaaagattaatccaatagggcatcctagttcctatccaatccccttggaatactcccctgctaccggttaggaagcctgggaccaatgattatcgaccagtacaggacttgagagaggtcaataaaagggtgcaggacatacacccaacggtcccgaacccttataacctcttgagcgccctcctgcctgaacggaactggtacacagtattggacttaaaagatgccttcttctgcctgagattacaccccactagccaaccactttttgccttcgaatggagagatccaggtacgggaagaactgggcagctcacctggacccgactgccccaagggttcaagaactccccgaccatctttgacgaagccctacacagagacctggccaacttcaggatccaacaccctcaggtgaccctcctccagtacgtggatgacctgcttctggcgggagccaccaaacaggactgcttagaaggtacgaaggcactactgctggaattgtctgacctaggctacagagcctccgctaagaaggcccagatttgcaggagagaggtaacatacttggggtacagtttgcgggacgggcagcgatggctgacggaggcacggaagaaaactgtagtccagataccggccccaaccacagccaaacaagtgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcgcctgctctggccctccctgatgtaactaaaccttttaccctttatgtggatgagcgtaagggagtagcccggggagttttaacctaaaccctaggaccatggagaagacctgttgcctacctgtcaaagaagctcgatcctatagccagtggttggcccgtatgcctgaaggctatcgcagctgtggccatactggtcaaggacgctgacaaattgactttgggacagaatataactataatagccccccatgcgttggaaaacatcgtccggcagcccccagaccgatggatgaccaacgctcgcatgacccactatcaaagcctgcttctcacagagaggatcacgtttgctccaccagccgctctcaaccctgccactcttctgcctgaagagactgatgaaccagtgactcatgattgccatcaactgttgatcgaggagactggggtccgcaaggaccttatagacataccactgactggagaagtgctgacctggttcactgatgggagcagctatgtagtggaaggtaagaggatggctggggcggcagtggtggacgggacccgcacgatctgggccagcagcctgccagaaggaacttcagcgcaaaaggctgagctcatggccctcacacaagctttgcggctggccgaagggaaatccataaacatttatacggacagcaggtatgcctttgcgactgcacacgtacacggggccatctataagcaaagggggttgcttacctcagcagggagggaaataaagaacaaagaggaaattctaagcctattagaagccttacatttgccaaaaaggctagctattatacactgtcctggacatcagaaagccaaagatctcatatccagagggaaccagatggctgaccgggttgccaagcaggcagcccagggtgttaaccttctgcctataatagaaacgcccaaagccccagaacccagacgacagtacaccctagaagactggcaagagataaaaaagatagaccagttctctgagactccggaggggacctgctatacctcggatgggaaggaaatcctgccccacaaagaagggttagaatatgtccaacagatacatcgtctaacccacctaggaactaaacacctgcagcagttggtcagaacatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccagctaaatacggaaacaaatatctattggtttttgtagacaccttttcaggatgggtagaggcttatcctactaagaaagagacttcaaccgtggtggctaagaaaatattggaggaaatttttccaagatttggaatacctaaagtaatagggtcagacaatggtccagcttttgttgcccaggtaagtcagggactggccaagacattggggattgattggaaattacattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccctatgaattgctctatgggggaccccccccgttggcagaaattgcctctgtacatagtgctgatgtgctgctttcccagcctttgttctctaggctcaaggcgctcgagtgggtgaggcagcgagcgtggaagcagctccgggaggcctactcaggaggagacttgcaagttccacatcgcttccaagttggagattcagtctatgttagacgccactgtacaggaaacctcgagactcggtggaagggcccttatctcgtacttttgaccacaccaacagctgtaaaagttgaaggaatctccacctggatccatgcatcccacgttaagccggcgccacctcccgattcggggtggagagccgaaaagactgaaaatccccttaagcttcgcctccatcgcttggttccttactctgtcaataactcctcaagttaatggtaaacgccttgcggacagcccgaacttccataaacccttatctctcacctggttacttactgactccagtacaggtattactattaacagcactcaaggggaggctcccttagggacctggtggcctgagttatatgtctgccttcgatcggtaatccctggtctcaacgaccaggccacaccccctgatgtactctgtgcttacaggtttaatgtttgcccaggacccccaaataatgaagaatattgtggaaatcctcaggatttcttttgcaagcaagggagctgcgtaacttctaatgatgggaattggaaatggccagtctctcagcaagacagagtaagttactcttttgttaacagtcctaccagttataatcaatttaattatggccatgggagatggaaagattggcaacagcgggtacaaaaagatgtacgaaataagcaaataagctgtaattcgttagatctagattacttaaaaataagttttactgaaaaaggaaaacaagaaaatattcaaaagtgggtaaatggtatgtcttggggaataatgtactatggaggcactgggagaaggaaaggatctgttctgactattcgcctcagaatagaaactcagatggaacctccggttgctataggaccaaataagggtttggctgaacaaggacctccaatccaagaacagaggccatctcctaacccctctgtttacaatacaacctctggattagtcccccctgagcctaacttcactattaaaacaggggcgaaactttttagcctcatccagggagcttttcaagctcttaactccacgactccagaggctacctcttcttgttggctttgcttagctttgagcccaccttactatgagggaatggctagaggagggaaattcaatgtgacaaaggaacatagagaccaatgtacatggggatcccaaaataagcttacccttactgaggtttctggaaaaggcacctgcatagggagggttcccccatcccaccaacacctttgtaaccacactgaagcctttaatcgaacctctgagagtcagtacctggtacctggttatgacaggtggtgggcatgtaatactggattaaccccttgtgtttccaccctggttttcaaccaaactaaagacttttgtgttatggtccaaattgtcccccgggtgtactactatcccgaaaaagcggtccttgatgaatatgactatagatataatcggccaaaaagagaacccatatccctgacactagctgtaatgctcggattgggagtggctgcaggcgtgggaacaggaacggctgccctaatcacaggaccacaacagctggagaaaggacttagtgacctacatcgaattgtaacggaagatctccaagccctagaaaaatctgtcagtaacctagaggaatccctaacctccttatctgaagtggttctacagaacagaagagggttagatctgttatttctaaaagaaggtgggttatgtgtagccttaaaagaagaatgttgcttctatgtagatcactcaggagccatcagagactccatgagcaagcttagagaaaggttagagaggcatcgaagggaaagagaggctgaccaggggtggtttgaaggatggctcaacaggtctccttggatgaccaccctgctttctgctctgacgggacccctagtagtcctgctcctgttacttacaattgggccttgcttaattaataggtttgttgcctttgttagagaacgagtgagtgcagtccagatcatggtacttaggcaacagtaccaaggccttctgagccaaggagaaactgacctctagccttcccagttctaagattagaactattaaccagagaagaagtggggaatgaaaggatgaaaatgcaacctaaccctcccagaacccaggaagttaataaaaagctctaaatgcccccgaattccagaccctgctcgctgccagtaaataggtagaaggtcacacttcctattgttctagggcctgctatcctggcctaagtaagataacagggaatgagttgactaattgcttatctggattctgtaaaactgactagcaccatagaagaattgattacacatagaaagccctagtgacctatcttaaatctctgcccggaagcctacgcagatgcggacctctggagctattttaaattgattggtccacggagcgcgggctttcgctattttaaattgattggtccacggagcgcgggctttcgctattttaaattgattggtccacggatctcaatattttaaaatgattggtttgcaacgcaca

SEQ ID NO: 205 - DNA, 8538 bp, artificial
  ss1841 sequence
tgcagcctaaccctccaagaccccaagaaggtagtgaagagccctaactccagcttcctaaaaagccctagtgacctatctcaactgcaatctgtcactccgcccaggagcccgcgcaaatgcggacctccggaactgtagaaaaatgattggtccacggagcgtgggctctcgatgttttaaaatgattggtttgcgaagcgcgggctttgttgtgaaccccataaaagctgtcccgattccgcactcggggccgcagtcctctacccctgcgtggcgtacgactgtgggccccagcgcgcttggaataaaaatcctcttgctgtttgcatcaagaccgcttctcgtgagtgatttggggtgtcgcctcttccgagtccatacgagggggattttccttctactggccttttcatttggtgcgttggccgggaaaccctgcgaccacccctcacacccgagaaccgacttggaggtaaagggatcccctttggaacgtgtgtgctggccggcgtctctgttctgagtgtctgttttctgtgatgcgcgcttttggtttgcagctgtcctctcagaccgtaaggactggaggactgtgatcagcagacgtgctaggaggatcacaggctgccgccctggggacgccccgggaggtggggagagccagggacgcctggtggtctcctgctgtcggtcagaggactgagttctgttgttgaagcgaaagcttccccctccgcggccgtccgactcttttgcctgcttgtggaagatgcagacgggtcgcgtgtgtctggatctgttggtttctgtttcgtgtgtctttgtcttgtgcatccttgtctacagttttaatatgggacagacggtgacgaccccccttagtttgactctcgaccattggactgaagttaaatccagggctcataatttgtcagttcaggttaagaagggaccttggcagactttctgtgcctctgaatggccgacagtcgatgttggatggccatcagaggggacctttaattctttttcttttttgctatttcttgggccgcccctgcggcatatggaggttcccaggctaggggtcgaatcagagccatagccaccggcctacgccagagccacagcaacgcgggatcccagccgcgtctgcaacctacaccacagctcacggcaacgccggatcgttaacccactgagcaagggcagggaccgaacccgcaacctcatggttcctagtcggattcgttaaccactgcgccacgacgggaactccctaattctgagattatcctggctgttaaagcaattatttttcagactggacccggctctcatcctgatcaggagccctatatccttacgtggcaagatttggcagaagatcctccgccatgggttaaaccatggctaaataaaccaagaaagccaggtccccgagttctggctcttggagagaaaaacaaacactcggctgaaaaagtcaagccctctactcgtatctaccctgagattgaggagccgccgacttggccggaaccccaacctgttcccccacccccttatccggcacagggtgctgcgaggggaccctctgcccctcctggagctccggcggcggcggagggacttgctgctgggactcggagccggaggggcgccaccccagagcggacagacgagatcgtgatattaccgctgcgcacctatgcagcccctccagtattggcccttttcctctgcagatctctatatttggaaaactaatcatccccctttctcggaggatccccaacgcctcacggggttggtagagtcccttatgttctctcaccagcctacttgggatgattgtcaacagctgctgcagacactcttcacaaccgaggggcgagagagaattctgttagaggctagaaaaaatgttcctggggccgacgggcgacccacgcagttgcaaaatgaaattgacatgggatttcccttgactcgccctggttgggactacaacactgctgaaggtagggagagcttgaaaatctatcgccaggctctggtggcgggtctccggggcgcctcaagacggcccactaatttggctaaggtaagagagatgatgcagggaccgcacgaacctcctatttcttgagaggctcatggaagccttcaggcggttcaccccttttgatcctacctcggaggcccagaaagcctcagtggccctggtcttcatagggcagtcggctctggatatcagaaagaaacttcagagactggaagggttacaggaggctgagttacgtgatctagtgaaagaggcagagaaggtgtattacagaagggagacagaagaggagaaggaacagagaaaagaaaaggagaaagaagaaagggaggaaagatgtgatagacagcaagagaagaatttgactaagatcttggcctcagtggttgaagggaagagcagcagggagagagagagagattttaggaaaattaggtcaggccctagacagtcagggaatctgggcaataggaccccactcgacaaggaccagtgtgcgtattgtaaagaaaaaggacactgggcaagggactgccccaagaagggaaacaaaggaccgaaggtcctagctctggaagaagataaagattaggggagacggggttcggaccccctccccgagcccagggtaactttgaaggtggaggggcaaccagttgagttcctggttgataccggagcggagcattcagtgctgctacagccattaggaaaactaaaagataaaaaattctgggtgatgggtgccacagggcaacggcagtatccatggactacccgaagaaccgttgacttgggagtgggacgggtaacccactcgtttctcgtcatccctgagtgcccaatacccctcctaggtggagacttactgaccaagatgggagctcaaatttattttgaacaaggaaaaccagaagtgtctgcgaataacaaacccatcactgtgttgaccctccaattagatgatgaatatcgactatattctcccctagtaaagcctgatcaagatatacagtcctggttggagcagtttccccaagcctgggcagaaaccgcagggatgggtttggcaaagcaagttcccccacaggttattcagctgaaggccagtgctacaccagtatcagtcagacagtaccccttgagtagagaggctcgagaaggaatttggccgcatgttcaaagattaatccaacagggcatcctagttcctgtccgatccccttagaatactcccctgctactggttaggaagcctgggaccaatgattatcgaccagtacaggacttgagagaggtcaataaaagggtgcaggacatatacccaacggtcccgaacccttataacctcttgagcgctctcccgcccgaacggaactggtacacagtattggacttaaaagatgccttcttctgcctgagattacaccccagtagccaaccactttttgcctttgagtggagggatccaggtacaggaagaaccggacagctcacctggacccgactgccccaagggttcaaaaactccccgaccatctttgacgaagccctacatagagatctggccaacttcaggatccaacacccccaggtgaccctcctccagtacgtggatgacctgcttctagcgggagccaccaaacaggactgcttagaaggtacgaaggcactactactgaaattgtctgacctaggctaccgagcctcagctaaaaaggcccagatttgcaggagagaggtaacatacttggggtacagtctgcgggatgggcagcgatggctgacggaggcacggaagagaactgtagtccagatactggccccaaccacagccaagcaagtgagagagtttttggggacagctggattttgcagactgtggatcccggggtttacgaccttagcagccccactctacccgctaaccaaagaaaaaggggagttctcctgggctcctgagcaccagaaggcatttgatgctatcaaaaaggccctgctgagcacacctgctctggccctccctgatgtaactaaaccctttaccctttatgtggatgaacgtaagggggtagcccggggagttttaacccaatccctaggaccatggaggagacctgttgcctacctgtcaaagaagctcgatcctgtagccagtggttggcccatatgcctgaaggctatcgcagcagtggccatactggtcaaggacgctgacaaattgactttgggacagaatataactgtaatagccccccatgcgttggagaacattgtccggcagcccccagaccgatggatgaccaacgcccgcatgacccactatcaaagcctgcttctcacagagaggatcacgttcactctaccagctgctctcaaccctgccactcttctgcctgaagagactgatgaaccattgactcatgattgccatcaactattgattgaggagatgggtccgcaaggaccttacagacataccgctgactggagaagtgctgacctggttcactgatgggagcagctatgtagtggaaggtaagagggtggctggggcggcggcggcggcggtggtggacgggacccgcacgatctgggccagcagcctgccggaagggacttcagcacaaaaggctgagctcgtggccctcacgcaagctttgcggctggccgaagggaaatccataaacatttatacgtacagcaggtatgcctttgcgactgcgcatgtgcacggggccatctataaacaaagggggttgcttacctcagcagggagggaagtcaagaacaaagaagaaattctaagcttgttggaggccttacatttgccaaaaaggctagccattatacattgccttgggcatcagaaagccaaagatctcatctcgaaaccagatggccgaccaggtcgccaagcaggcagcccggggtgttaaccttctgcctataatagaaacgtccaaagccccagaacctggacggcagtacaccttagaagactggcaggagataaaagaagatagaccggttttctaggatcccagaggggacctgctatacctcagatgggaaggagatcctaccccacaaagaagggttagagtatgtccaacagatgcatcgtctaacccacctaggagctaaacatctgcaacagttggtcagaacatccccttatcatgttctgagactaccgggagtggctgactacccgggagtggtcaaacattgtgtgccttgccagctggttaatgctaatccttccagaatgcctccgggaaagagactaaggggaagccacccaggcgctcactgggaagtggacttcactgaggtagagccagctaaatacggaaacaaatatctattggtttttgtagacaccttttcaggatgggtagaggcttatcctactaagaaggagacttcaaccgtggtggctaagaaaatattggaggaaatttttccaagatttggaatacctacagtaatagggtcagacaatggtccagcttttgttgcccaggtaagtcagggactggccaagacattggggattgattggaaattgcattgtgcatacagaccccaaagctcaggacaggtagagaggatgaatagaaccattaaagagaccctcaccaaattgaccacagagactggcattaatgattggatagctctcctgccctttgtgctcttcagggttaggaacacccctggacagtttgggctgaccccctatgaattgctctatgcccccccccattggtagaaattgcctctgtacatagtgctgatgtgctgctttcccagcctttgttctctaggctcaaggcgcttgagtgggtgaggcagcgagcgtggaagcagctccgggaggcctactcaggagaaggagacttgcaagttccacatcgcttccaagtgggagattcagtctgtgttagacgccaccgtgcaggaaacctcgagactcggtggaagggcccttatctcgtacttttgaccacaccaacggctgtgaaagtcgaaggaatctccacctggatccatgcgtcccacgtcaagccggcgccacctcccgactcggggtggagagccgaaaagactgagaatccccttaagcttcgcctccatcgcctggttccttactctaacagtgactccccaggccagtagtaaacgccttatagacagctcggacccccatagacccttatcccttacgtggctgattattgaccctgatacgggtgtcactgttaatagcactcgaggtgtcgctcctagaggcacctggtggcctgaactgcatttctgcctccgattgattaaccccgctgttaaaagcacacctcccaacctagtccgtagttatgggttctattgctgcccaggcacagagaaagaggaatactgtgggggttccagggaatccttctgtgggagatggagctgcgtcacctccaacgatggagactggaaatggccgatctctctccaggaccgggtaaaattctcctttgtcaattccggcccgggcaagtacaaagtgatggaactatataaagataagagctgctccccatcagacttagattatctaaagataagtttcactgaaaaaggaaaacaggaaaatattcaaaagtggataaatggtatgagctggggaatagttttttataaatatggagggggagcagggtccactttaactattcgccttaggatagagacggggacggaaccccctgtggcagtgggacccaacatagtactggctgaacaggggcccctggccctggagccaccacacaacttgccggtgccccagttaacatcgctgcggcctgacataacacagccgcctgacaacagtaccactggattgatttcctaccaacacgcctagaaactcccccggtgttcctgttaagacaggacagagactcttcagtctcatccagggagctttccaagccatcaactccaccgaccccgatgccacttcttcttgttggctttgtctatcctcagggcctccttattatgagggaatggctagagaagggaaattcaatgtgaccaaagagcatagaaatcaatgtacatgggggtcccgaaataagctcaccctcactgaagtttccgggaaggggacatgcataggaaaagctcccccatcccaccaacacctttgcaatagtactatggtttatgagcaggccttagaaaatcagtatttagtacctggttataactgatggtgggcatgcaatactgggttaactccctgtgtttctaccacagtctttaaccaatccaaagatttctgtgtcatggtccagctcgtcccctgggtacactaccatcctgaggaagtagtcatcgatgagtatgactatcggcctacccgctcaaaaagagagcctgtgacccttaaccctagccgttatactaggattagggatggctggtgtggggacagggacagctgccctgatcacaggaccacagcagctagaaacaggacttggtgagctacatgcggccataacagaagatctccgagccttagaggaatctgttaacaacctagaagaatccctgacttctttgtctgaagtggttctacagaactggaggggattagatctgctgtttctaaaagaaggtgggttatgtgcagccttaagaatgttgcttctatgtggatcactcaggagccatcagagactccatgagcaagcttagagaaaggttagagagacgtcgaagggaaagaggctgaccaggggtggtttgaaggatggttcaacaggtctccttggatgaccaccctgctttctgctctgatgggacccctagtggtcctgctcctgttgcttacagttgggccttgcttaattaataggtttgttgcctttgttagagaacgagtgagtgcagtccagatcatggtacttaggcaacagtaccaaggccttccgagccaaggagaaactgacctttagccttcccagttctaagattagaactattcacaagacaagaagtggggaatgaaaggatgaaaatgcagcctaaccctccaagaccccaagaaggtagtgaagagccctaactccagcttcctaaaaagccctagtgacctatctcaactgcaatctgtcactccgcccaggagcccgcgcaaatgcggacctccggaactgtagaaaaatgattggtccacggagcgtgggctctcgatgttttaaaatgattggtttgcgaagcgcgggctttgttgtgaaccccataaaagctgtcccgattccgcactcggggccgcagtcctctacccctgcgtggcgtacgactgtgggccccagcgcgcttggaataaaaatcctcttgctgtttgcatcaagactgcttctcgtgagtgatttggggtgtcgcctcttccgagtcca

SEQ ID NO: 206 - DNA, 6375 bp, artificial
  ss1876 sequence
atgaggctgcaaaaatgactaagcattttgtagaacctgatgagaggactcccttttcaccaagacctcaatctcctggtcccatggctgttatgatggctaaagatgaggaagaaaaattctttgatcccaaagagcaacaggagctaaaagaggaagaaaggaggtatgaaaggaataggttggaaagagatgtgtctttcccaaaaacatctattaaaagttttaacttcttaaaaaataatcctccacctcctacactggtggaaaaaaacacctaaatctgagggcctttctctctttggtgaatagcatcccattggcccagaaattcatcctaaatcaggcctttcaaaggcacaaaaggaggctgaatgtaagggagatcttgatttttctttatgtttcccagtaacttaaggtcctctgagaagccaagacaaagaggagggacctccccagtggaatcctgtacattacaaactgcttaaagaacttaatctgcttgtgttcaatatagaccattagctccctatatgctaacccttcttgattctgtagcaaattaggtagatgacccctcatgattgggtacacattactaaaatttgccttactagaggaaattatttattatggaaggctgaatttgagaatttgacttttcacattgcacgaaaagtaaaaataaaagagataaatgtctaaataaaattgattttagtatgttaacagggtctggagaatggtctcaattaacaatcaggtacgtcttccagaagaggcatttaaacaaataaatgatgctgctattgctgcatttgcatggtgggctcctccacctggaggagattccacctctacttctcccttatcttaggttaagcaaaaggctgatgaggcctatgaggattttgttgctagattaatgggtgctgtttggagggtcatttccaataaaaaggaggcaataattttaattaaatacttggcttttgaaaatgctaattctgcttgccagtcacttctgaggcctattcaaaagacaggctctatgtcagattttattagacaatgtgctgatgtcagtgcagcatatattcaaggagtggctttggcagcagcgttaaaaggggaaacatattctcagtttgttcaaggcataaataatcctagaaggccttctaaacctccatcaggaatttggtctacttgtcagcagtcaggtcattttagcagggattatcccttaaagaaaaaaagttctcaggtgcctctaacaaaacctgcagggtctaatcaccctgcaaagactttatgtcctcggtgtctaaagggtttccatcagacaaaagattgtagatctaaatatcataaaaacagacctcctctaatgccatcagattatccttatgtagctgagtcatcatgaaatggggtgacgggacagccatcgtggccccagtcaacaataggggactggcagataatgatccattcataccctttgtcccatctcagagctcttccgagcaacaccaggaagtgcaggattggacctctgttccaccaccacaacaatattaactcctgtatgcctactgttcctattcctactggtataaagggccccttacctgaaggggtggtaggcattattttaggaagaagctccctgtctctacaaggactttctgtgattccaggagttctagattcagattttactggagacattaaagttatggtgagtcctccttcaaaaaatgtacaattacacaagggaaagaggatggcacaaattgtttggctaccttaacttgatatggggtcttctgttaacagtgccccccaaggagatcaaggatttggatcaagtgacttagccttctgggtacaaaaaatttctatctaaaggccatttaaagatttaaaggtccaaggggtcattattaaatgacttatagacacaggggcagatgtgtcatgcattgctggtcatgcaatccttccttctggcctacccatttgcctaacacatctcttataggaattggtcaagtttctaatgtggaaaagtgctctcagattttgatttgggatgatggataaaacaaaggaaatttttgtccttatgtaattccatcaatacctttctatttatgcagaagggatgttttaacacaaatgggaatgctactatatagtcccaatgacaaggtttcttataaaatgcttcagatgaaatacaacccagataaaggactgggaaaaaaatggaagaggacagaaagaacccattatggtaaaaaaaaaaaaaaaagagaacaggaattggctaacaaaatttataactttggccattgtttctaaagctgctgaccctataatctgcaaaaatgatgatccagtctgggtggaacgatagcctttaacctcagaaaaactacaggcagctgaacaatgaatttgggaacaggtacaggcagggcatattgaaccttccttgagtccttggaatactccaatttttgttataaaaaataaatctggtaagtggaggttgcttcaggatttaagggtgattaatgccactgtggagtctatgggggctttaccacctggactccctgctctggtggctatacccaaagattataatatcataataattgatcttcaggactgtttctttaccattcctttatatcaggaggattgtaaaggatttgcgtttaggtctcccttctgaaaatttaaggagaccttaccaaagatattagtggaaagtgcttccacaaggcatgaaaaacattccaacattttgtcagaaattggttgatgagggcttatgtactcttagacaaaagcatcctgacctttatcttattcattatatggatgatattttacttgctcactcagagaagtcttataacaattattaaaaaaaactgtacaggcccttactgaccatagattaatagtggctctggaaaaaattcaagttcaaccttcattttcctatttgggaacaattttaaatagtgaaattgttactcatcaacctctacagttgagaaaagatcatttaaacacacaatgatttccaaaaattattggggaatataaactggattagaccacacttaaaattgatgactgttcgttcagttattgcctttgtttcagtagttacaaggggattccaatccaaactcctctaggagtctgacccctgaggcttacactgcattaaaagaggtggaattggcaatatcaaactgtcaactgaccagattggagtataataggccatggagttgattcttcaaacatcatagtctcttatggcctgtttgtggcaacatggactttggagtggattcatttaccagcaactcctaaaaaggtcttggcttcttacccttttcaaactgctgctttaattacaacagggctaaaaagaaggcaagaattatttgacagagactgtttaccttataataaacaggagtgtgaaaccctccttcaggaggacaaagattggcaaattgctttaacaagttttttaggacaaatctcttatcatttgcctaaaagtcctttgttacagtttctaaaggaacatgatactgtctttcctgtctggtgttctaaaaagcctcttgaaaatgcagccttggtttttaccgatgggtcatctaatagaaatgccaaaaggaatgggtaagttttcaaacagaagaaaagtctgctccgaggatgaattaaaagcagttatacaggcatttttattacttaaagaccaaaagtttagtttgtactcagattcaaagtagattgtgggggtgtttcctcaaattgaaaccgcagttacaccaatatataaaactccaatttcttccttacttacagagttacaaaaacttactcaccatagaatggagtcatttttctttggtcatattcgagctcattctcaattgcctggtcatctccacaaaggaaatgctaaggtggaccaattaaccaagtcttactaatgacagaggaagataagataaaagaggcaacctatatccatgctattcatcatcaaaatgcttctgccttgagattacagtgtaacattacaagggaagctgccagacaaattgtaaaacgttgtgatgtttgtcctcaaactgtaggagaaaatgtcccagtaaaatgtagaaaggagagaccccagccatgatgactaagcaaagtctagccaactgccccaaccagtcctcccccatgcatctgcttccgcatctactaccttgcctgacgtcactccagtccaactagtcaagcttggacccagaagatgtagcccataaaagccttgtgaaacccttcttctgggctcagactctggagagcgatcccctctgagcccgccggcgtaataaaactgagttctccaactctccgagtgctcgcttggtttctcaccgggtgaaagagctgatccactgcagccgcaaagctgccagagctgatacactgcagcgcagggctgctgggtatctgccgtaacatttctggaggccccagcgagattccaaccattctggccccttgagccaccggaacagaggtaaggccgcccgggagccggggagcctcaaaccgaatgaggcggcgcgccacctgacggtattccaggtcctccttcgtaagcggcattcctgactcccgggtgaccgaaacctgaccagactcagtggagagatggaccaactcaccagaaaggcatccggacagggtaaggccccggggccaaccccagtcaggtcctgccccagtgggcagaagaggggactgatcaccccctgagggagactctcctggttggaagctgtgcctgaccagagcagcagtcctagtgctccagattggaagcagaggaacctcttgcttgggtggagcaactgtcaggtgtagccaattgaaagttgtgcttgatcgagctactagttagggattcccagggagtgggaggcattgtgataacctctgagtgtgtgtgagagtgaatgagcggcctgattcacttgcgcttcaagttcgagtttgtggctccatggtcttagtggctacggagtccgagtgggtcctaacctgcagttccgcggtgacctcatagggcttatggctgcagcggactctgagggtcctcgtccctccctgtgagtccaatccaagtttggggcttatacgaaccagccaattgctaagaggcacctaaactcccaagaggtgagcggtcaggaggacatctgaatggccaccttctaaaaagggggcaccctcccttgtttcatctgtgacaccggcacagggtggccacatggggtgggacctaacccagaagcccacgagccagagacccctgtgcgtccgccatcttgggccataaattcctccaaggagataatctaactggactttgcccctgggcctccaggaactcctgtcccagactctagaccagccatgggactgcccattttgtaagttcatggagacccaggatctgagtcaaggagacaagcctgtcatccctggctcagttcagggtatagggaggattgggtacaaggtcccctgtcctttgcccaaaacattagaacttgtctgagagtgccttcctgagacttggggcccagatggattggagatacttacaacaaagcaggttctcttcccagttatagagcaagctgagtgggatctgtcttgctttcaagagtggtggaggcaaagctattggggataccacccatgaggccagagaaggtctcataatatcaggccatagaaaagatccacataaagacaccatgggttcacccaagtctaaacctgtggttgtagactgtgtgatcaaagatttcaaaaagggattttctgaagattatggtataaaactaacctgatctttcatcatttcctttgccattacctcaaatagagctgtgggggcaaaggaagcagacctctagatgataagaccatcctgagttgttacctggtctgtgggggaaaaggagttaatagctagtattcatccaacttaggccaagtgtttagcctcagagccttggcatagtcagttttgctttttgctgtttactttcaccctggtcggagtaattgatggctggttcatccaatttacctgttaactgtggtttagaaactttcctaatgttaatacagggcatgtcagagtgagcatcttaggattcaaaaacccagggcagggcctgtatgcctgggttttcttcacctctgtccagagacagataatgggcagggatgacaggaagagaggctctg

SEQ ID NO: 207 - DNA, 4467 bp, artificial
  ss1883 sequence
  misc_feature (1898)..(1997): n is a, c, g, or t
actgaggtcagacagtgtataacccttctctcaatgcctacttcccacagagcttccagcactttctgtatccattagtttgttcccccatttcccatttaaaacaagctagaagacagacttactcttcttttccctgaaaaaatagaattccacttctcattccttcttacatataccttctatgtctctctcagtaaggtctctaatagtttatctttccaatcctttattatatatatatatatatgtatttatacttattattttgtctttggagggctgcacctacagcacatggaggttcccagaccaggggtccaattggagctgcagccaccagcctacaccacagccacagtgatgtgggatctgagctgcatctgcaacttacaccacagcttctagcaacactggatccttaacccactgagtgaggccagggactgaacccccaaccccaagtttcccagttagattcacttccattgcaccacacattgttttaactctcgcctaagtctggaataaggccctgacatatcctttggttttgttgaggcattgggctttgatgccacaggccagggcagcacgtttgcgcctgcagcctaagcctcctgttctgactctgcgagcagcagtagtgcatttgtgcctgcatggggctctgcaatactcccctcccgtgttacctctgtgagcagaggcagtgcccttgtgcccaggtggtgggctctgcacccctccccataccatgctcccctggcagtgacagcagtggcagctgtggctggagggggaccagcaccactttgaggattggaaggtggcagcagcaagccaagggggtcccatggaggggaggtggtcccagaatgttcctggatttccccctcatttcccttttggtctcgtgctctgaggggaaataagaccatcagtctctgctgccaacagagaccataacaagtttcctcctgtgaccccggtggcttgtcctggacaaacttaatgagcagacccaatccttgtcccatccgaactttggccagaagatggatggagtgagaataggtgtctgtgtcccaataaaacaacacttaatcattcttaccttctttctctctgttgtcctatttattcattcttcctttctttctgtccttcatcctctttaattagtcttcccttctttttgtccttcatccatggattgtcaccccactactttaatatcaatcccagaggatggtctggaggaatttggtccccactcccattcaatcctccccagggaggtacagcttgagaagacttacttcccatttcccaggatcatgttctgatgctctgatttcagcgaagatcactggtctcaccagagaccttttgagagtcgtgctctgattttatgatttcacccaaaattgccaatttcacctgaaacctctggtctcacctgagacccattgaggcttaccgacccccgtccccaaccaccaaggaggtgctcgatcgaacccgcaatctttcctaccttggtccattaatggaagttgccttgttggtcacatgatttcctgtgttgtcaagaaccctccacaggtttgaagttcacaggcacagacttctcaatttagggccaccacagcaggccatgggacacgtctcccctccttgagaatccatgctccagtggaccccaaatcccagataagtgcccaaatctgttggggacatggcttggatcattggatcatcagtgtcaaaaaatgagacacatgaacacggggagatcttgatgaagatctttacttctgtggaagggggtgggtgctccaaaaagcacatgcactgaccaaaggaccctcccctatttatccctaaagcagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccaagattcctgacaattgggcattgagtcttattgatgtaagacattgtttctttacaatataccattagcagagcaggacaaagaaaagtttgcttttacccttctctctgttaactgtgctgcccctgcggagagataataatggtgaattcttccccagggaatgatcaactgggcaactattggtcagcttgtagtgaggcatgctttaaaacctattcatgaaaagttccctcaagtcatgatacatcattatatggatgatatcttatttgcccttccagaaccatctgtctttcttgggcttttaaaaaaattgctacaacactttctaaaatttggcctacagatggcccctgaagaagtacagtgacaattgccctggaaatatttaggacaacaggttttttttttttttttttttgtcttttctagggctgctcccatggcatatggaggttcccaggctaggggtccaatcagagctgtagctactggcctacaccacagccacagcaacgcaggatccgagctgcatctgcaacctacaccacagctcatggcaaagccagatccttaacccactgagcaagagcagggatcaaaccacaacctcatggttcctagttggattcgctaactactgaggcacgatgggaactccaggacaacaggtttttgatcaatgtattaaacctcaaaagttgactttacaaagtaatgtgaaaactcttaatgatgtgtaaaaattaatgggaacaattaattgggtatggcccatggtaggaattaaaaatgaagaaattacaaatctctaagcattgttaaaagaagaaaaggacttaaattcccctcaagagttaacatctttagcagaacaggagttaaatttaattgatcaaaaattaatactcatagttatcatagatgtgatcctgatttgtctcttatttatcccacatatggcagtattttcagcagcattacttggacaaaataacaatcctattaaatgtattgaatgggggacttcccatcttagagcagtggaaatgaatctgactaggaaccatgaggttgtgggttcgatccctagccttgctcagtgggttaaggatctagtgttgccgtgagctgtggtgtaggtcatagacacagctcagatcctgtgttgctgtggctctggtgtgggctggcatcaatagctcccattagacccctagcctgggaacctccatatgccacaggtgcggccctataaagacaaataaaaaaaaaagtattgaatggggtatttctttcattaacacttaaatgtactttgactcccataattgtaaatattgcaaatcttattttaaaagtcagaccgagatctatacaattatcattattatacaacaaatcattattcctcttatagtacatggttcgaaattgctattgccactagtatagatctacaattggcattagctgattttgtaggaaagataatgtatcatcttcccaaacatccattatttaaaatttgtgaagaacaatttctggggcctgaagcaattattaaaaactctccccatttcagatgctagatatttgtttacagatgcatctggaaaaactcatcactatagaattacctggtttgaaaaggattggaagtcaaaggaacttcttatggacccactcaagatttggaattgttagcaataattaaagctttacaaatgttttctgatgcatgcaacattattagtgattctcaatatgaggtaaaattaaattcttcaatttccaatggctgagttaaaaatcctattggataagtagtttgctgtatcgttaacaactgtaaaaaaaggtactcagagatgtgctcctttgtatattggtcatgtctgatcacatacagatttaccaggttggttacaagaagggaatccaaaggcagatagatgagtatctgctactcctttgagaaggctaagtgttctcacaatctttctcatgaaaattggaaattgtttaaaatgagatttaactccatagtttcagaagcaaaacaaatggtcaagacttgccctgttggccaattgttttagcctatccatttccccagagggacaaaccccataggtttacaccaaatcagttatggcaaacagatattacacattatcctgagtttggaaaggtcaacatttattcatgtctcaatggatacttatgcaggagtgctttgcactactgcccacagcaaagaaaacatcagggcagtaattcaacatctggtctcagtatgtacagtttggggaaagcctaaagtaataaaaacagataatggacctgcctatactagtaaaacacgtaaagaattttggcagctatggggaataatgcttaaaacaggaattcctcacaatccacggggtcaagcaattgctgaatgggcacatcttaca

SEQ ID NO: 208 - DNA, 8156 bp, artificial
  ss1855 sequence
  misc_feature (5324)..(5324): n is a, c, g, or t
  misc_feature (5466)..(5565): n is a, c, g, or t
tgtcttttctgtcaaaggaagtcttggttactccattttgctcaggctcccgcttctgctcaatcaaccctgcagcccccttcctccttacctctttttccagcaacaatctgtttcaaattagccaaccaggaagaatgtgcaccctgacctgatcaacgcgaaggggacaggtaaatcacctgcgttagggataaatgggggagggtcctttgttcagcgtgcacactttttggagtgtcctcgcccttgtacggaagtaaagagccttgtcgagacttttccttgtccacatgtcccactttctgacactgacaacctgagccagagttattgtaatttccaacagacttggggggttttccgggattcggggtccactggactatggactctcgaggaggggagacgcatcccacagccctgttgcagtggccctgaattgagaagtctgcatctgtgaacttcaaacctgggagggtctctacactcgggaaacgcagatgacagcactttcatcatgacagtagaaatctttgtgtcgggggaaagggggtccgtaagtctcaaaggtctcgggtgaggccagcgatttcggatgaaatcataaaatcaaagcacgaccctcaaaggcctggggtgaggccggtggtctcgggtgaagttggaggatcaaaacaacgaccctgggaaatgggaagtaagtcttcccgacttgtacttccactggaggatcaaatggggggggaccaaattccttcagacagccctctgggattaatgttaaaatattggggcaacaatccacagatgaaggacaaaaagaagggaaaaatgattaagtattgctgctttatctggacgcagacacctgcccttgccccatccatcttctggccaaagttcagatcagacgaggattgggtctgtcagctgcttattcaattgtccagaacaagacaccagggtctcaggaagaaactgattatgctctctgttggcggcagggacaggtggtcttatttcccctcaaagcatgggataagaaggaaaaagaggaggaaacccaagaataattggggacttcctcccctccgcgggacccccttggctttctgctgccaccttacaatccccaaaatggtgctagctcccctccggccgcaactgccactgccaggggagcacaagaggggcaggggcgcggagcccactgcgcaggctcaggcgtgctgccccccactagctgagtcagagcaggaaggggaggagcctagagcccaccaggtgggcacatgttcactgccactgttcggggagtcagaacaggagcggggggcaccgcaggcatagacatactgccgcaacccgcgggatcaaagcccagcgcctcaacaaaatcaaaggatatggcagggccttattccagccttaagagagagttaaaacaatgtcaggaggatattcaaaattttccttttcccactgctacccctggggatagacaagaagggccacaaatgctcttcccactacaggaggttcccttaggtgggggaggaagaggatatgtaaatgcccctttaaccagcactgaggtccgaaattttaggagagaattgcgaccattgctggaagacccatatggggtagcagatcaactagatcaattccttgaaccacacgtctatacatggtctgaattaatgtctattttgagcattctgttctctggagaagaaagggggatgattcgaagggcagccatggcctcgtggaagcgaacccatcctcctcaaccgggagaagttagggcagaaacaagatttcccaacgaggaccccggatgggacaataacagcgtggtccaccagggacatacgatggatttgagaaatctaataattcagggcattagggatgccgtacctccaactcaaaatatatctaaggcatttgagatgcggcaaggtaaagaggagggaccaactgaatttttggaaagactcagaattcagatgagacgatatggtggaatagattccaccgaccctctgggacagggcatgctcaaacttcaatttgtaactaatagttggccagatatttccaagaagttacaaaaaatagagaatgggaaagataaaccattagaggacctattaaaagaggcacaaaaagtttacatgagaagggatgagggaaagcaaaagcaaaggaccaagatcatgtttgcatatcaacaaaaacaagacagattaaatcaaaggggttctaaagacaaaagtaagagagggtcacaatatcagcctcactgctacccagaaacaggacagaagggcaaggggaatagatggcaaggtgaaaacaagtgcttgaggtgtggcaaatcgggacatttcaaaagggagtgccctgagtggaaaaaggaggagaaaacaatccctgtcatgttatttgaggaaaatgaggactaggggtgtcaggggctcccaacttaaaaatccacagatgccctacccagagcccttgataaatttagaggtaggaccataccatgaaactatgttttttcttattgattcagaggcatctcgctcctcactttgttacttgcccaaagggctttcttcttcatgtgaacaaatagtatctggagtaaaatgggagggattctctgcaaaaactttagaagagaccaaagtaaatttccaaaacagatgtgccagaatatgcttcctttttgttccagaggctggcacaaacctgtgcggaagagacctaatgaccgaattgggattgggtttacagtttaccaaaaaaattttacaagtaaaattaaatcttttaatcccaacagtggagggacaaactcaaccacaagtgtgggcatcagagggaaatcgtaggggacttaacgtgaccccaattaaaacacagttaaaaatccctggagaagtagtccagagaaaacaataccctctccctctacaaggaaggatgggacttaagccaattatagagggacttcttcaagagggtctcttagaaccctgcatgtcttcctataatacccctattctccctgtaagggtcctattgcttggtccaggatttgcgggcaattaaccagattgttgaggctaaacatccggtagtcccaaatccctataccctcctgagtaaaattccatttgaccaccaatggttcagcgtaattgacttaaaagatgccttttgggcatgccccctggactcagacagtagagacctattcgcctttgaatgggaggacccagtaactggaagaagacaacaatatagatggacagtcctcctccaggggtttgcagactccacacatcttttcaggcaaattttagaacaggtgttgggagactttacacccctcacaggacctgtctactccaatatgtaggtgacttgttactattaaacatggatcaaaagaaacttacagcaactacagtttcccttctcaatttccttggggaacaaggccttagggtctctaagaaaaagttacagtttattgaaaaggaggtaaaatacttaggacatctaataagtgggggtaagagaaaacccagccagaaagaatagaggggatcataggcctgcctctgccaactaccaaacatgaactcggaaaattcctaggcctgattggatattgttgcctttggatcaactcttatgcattaaaaactaaaaatctatattctaagcttgtggaggaaggcccttaccccctactatggagccaagaggaaatacagcaattcagggatctgagggattcgctgacaggtgcccctgtctggctctaccctcctttgaaaaaccttttcatttattcgtaagtgtggacaggggaacggctctaggggtcctcacaaaggaacatgggggaagtcgccagccagtggcctttctttcccacctcctggaccctgttgccagaggatggcctgagtgcctacagttggtagctgccactgccctcttaactgaagagaacaggaaacgcacctttggagaaaggctaaccgtgagtacctcacaccaggtatgagccatcctaaaccaaagggtagggagatggctcactgactcccgaattttaaaatatgaggcagtctcattggaaagggatgacttaactttaaccattgtgaggctttaaactctgcttctttcctcactcaaagggagccctcaactcccactgaacatcattgtttaaatttaatagactatcagaccaaaactcgacctgatctatgggaaactcccttccgttcagggagacatttattcattgatggatcttctcgggtcatccagggaaaaagacataatggttactcagtcattgatggagagactcaatagataactgagtcaggaagactcccaaatgcatggtcggctcaaacttgtgaactctttccccttaaccaagccttaagatatttaaaaggaaagaagggcataatctatactgactctaaatatgcctttggagtggtccatacctttggaaaaatttggatggaaagggaacttattaacagtaaaggacagggactaatacatgaggaattaattaaacaagtacttaataatctccaactcccagaagagatagcagtggtatatgtgcaggtcaccagaagggggtctcatctgaagcctgaggaaactccttagcagatgaggaagtcaagagggtggcattagaatcggaggttcctatcttccatcttacttgctcccttcccaaaataacaatctctccctccttttcagaaaaagagacggaacagctaaaacagctgggggcccaacctgacgctcagtgaagatggttcctccggatgggaggttaatgctatccaaacctactatgagagaaattctgacacacctacaccaagggagccagtgggggcctcaggccatgtgtgacacagtcttaaaggtctatctgcgtgctggtatttacacaatggccagacagacagaagggattaccagcccaggctccaccgcttgatttcctggtccattcaccagcctggagactatgtgctaatcaagtcatggaaagaggacaaactccagccaacctgggagggacctttcctcgtgttgctgattgctgattactgaaactgcagttggaatggctgagctaggatggactcaccacacccgggtgaaaaaaggggagggggccataacagacaaagaacaatgggtggcttctccagggaccaccaaaacccagttggtcttanaaagggctcaaagttatttatgacatgggtgactatttggggatcattagtatttggtaatccgggtgaatcatgggaccctctaactccaaatattatcagggcctaggattatgggcaggtatcccaccaatttagtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcagggcctaggattatgggcaggttatccacccaaattagttattaacttaacccagactcctaacccaatagtcataaaatttgatgcttgccaggtcctagattgtggaactctagaaaggcaaagacaactttcatctgtagataaatgtctttgtccagaactcagcccacaagaactatataaacaagggggaacacgggagtacgaatacccatgtgcaagttgggatgatgtttggtggaccacccaacacaaggggtggacttccccctaggctcataatttaggagcattaagagacaagattcaggagttcctgtcgtggcgcagtggttaacgaatccgactaggaaccatgaggttgcgggttcggtccctgcccttgctcagtgggttaacgatccggcgttgccatgagctgtggtgtaggttgcagatgcggctcggatcctgcgttgctgtggctctggcgtaggccggtggctacagctccgattcaacccctagcctgggaacctccatatgccgcgggagcggcccaagaaatagcaaaaaaaagacaaaaaaaaaaaaaaaaaaagagagagagacaagattcacatctcaaagggagagcccccaattagttgtacccacttaacatgtaatccaatcttgttaactatcaacaacagtcaccttagcccagccacgatcagtggcaactcgtatataaggtttaggagctcatatttctgggacagacccagtgggacaaatggctcttaggttagtaccttcaacccaaccaattactctttcttcccaatctccaagatccactcctccccttagaccctcacctctccccaatccacgccctcaaaatcatcctaatatagttaaaatggttgaagttaccaacatcaaagaaacaactcagatagaaacaggatatggggacacaaatgcctggttgggatgggtaaaatattctgtgggcacattacataaaagcgattgttacgcctgtgccatagggagagcggaggccctggtggttccctatcctctgggatggtcatcagacccacaggatcttcaatgtatgatggcccttttccaggacaaaacagcttggaataatgagtcctgttggaccctgtcactgctatttcctgaagtcaaaagttctgcagatcagcccccccctcccccccgagaactgttttgctgccaagtaaaaacatcagtttctcctcctgtctagaacgacaggaggcagagatgactttgttaggcaacctgaccacatgcagtgacagctggtcctacaacaccctccacaataaatcccagttccgtgtgccccaggcagatgtctgctggtattgtgggggtccgctaatgggcagtctctcggaaaactggagtggcacctgtgctttggggcaattggccatccctttcaccctggcatttaggccccaattttgaactcagccaatccgaaaggaacgagacacgactccaggggggcctttgacccccaggtctatattgactcaataggtgttccctggggtgtccaaaacaaatttaaggcaagaaatcaaatagctgctggatttgaatctgctctcttttggtggtcaaccataaaaatgttgattggataaactacatctattacaatcaacacagatttgttaactacactagggatgtcattaaaggaatagcggaacagcaagggccaactagtcaaatggcatgggaaaatagacttgctttagacatgatgctggcagaaaagggtggcatctgcgtaatgactggtgtccagtgctgtactttcattcccaataacaccgccccagatggcaccgtcactaaggccctacgtggattaacgaccttagcaaatgaactttcagagaattctggtactaatgacccctttacaggtcttttagaaaattggtttggaaaatagaagggactaatagcttcaatctttacccctcgaattgttgtagttagtgtccttgtcttagttgcacgttgtataattcctcatgccaggggacttattcaaagattaacagagactgccctaacaaagcaactacgactccatccccaccaagccaatatactcctaatggatacaatagagcatgaaagccaaaccatgcccaaagtttgaagaaaagaatatttgataaaaaaatgaaaggggagaattgtggaaagtaacataatgtcttttctatcaaaggaaatcttggttctctattttgctcccgctccagcttctgctgaatcaaccctgcgaccccccccccccctcttcttccagtaacaatttgtttcaaattagccaactgggaagaatgtgggccctgacccgaccaatgggaaggggacaggtacatcatctgcgttaggggtcaacaggggagggtcctttgttgggcatgcacactttttggagcacccgcgcccttctgcagaagtaaggagccttgtcgagatttctccttgtccacgtgtctcactttcctgacactgatgacctaagccagagttattataatttcca

SEQ ID NO: 209 - DNA, 9164 bp, artificial
  ss1856 sequence
atggggaaccaaacatccaccatactaaatgacagcccattaggatgcatcccacagaattagaagttttttaggtatcatcccctgaccagaaagcattaattctcttatgtaatacagcctgggcctgataccagctaggaaatggggaaagctggcacattaattagtctctaagtcataacaccattttacaatcgggcctgctatgctagtacaaaagaacaaaggctctcaatgtattcctaatgggggaagaaaaggccacagtctttaaaaagcccaagaaaaggccacagtctttaaaaagcccaagaggaagcagacaaagagaacagacaccatgcaggtcatgttattttcagacctgggaatgaagaggtcctagataacaaacccaactgggattgagaaaatggagaaagaagtggaaggcaggggctgacctattataaactgggatcctaaagggagtccaggcagcaggaaaggaaactgtcacctggaaggaggtaaaatcacaccatcgagagctgaaggagaactcttcggcattcctagagtgcctcaaggaatgcctccgaatctttgtgaccactgactatgaatcactggaagggaatgtaaccctaaggtcatacttcatttcccaaagtgcccccaacattaggcataaacttcagaatatggaaatagaaccagataccctcttgccttgtggaaggtgcctactacacacttaataacagaggtatagaggaggaaaagtcaggataaaaaggcctggaggaggacttccattgtggtgcaggaggttaaggatctggcattgtcactgcagtggcttgggctgctgctgtggtatgggtttgatccctggcccagaaacttgaacatgctgcaggtgtagcccccccccccaaaaaaaaggcctggaggaaagcccacctattggctgctgccctccaatgtcacctggtcagcataggaatccagactaagtgcccagagactcttgactctggtgagtgactcctggcccccaccaagggacagcaagccaaggaaattgggacctagtgtgccatatgtaaataagagggatactggaagagagaatgcctttgatgtgccccaaagggggacataaatggcagatcccggccactaccctggcaaatggtccaaatggatgaaaatgatacagccagggggctcctaagctggcactctaattgactccctaggggttccagctaacattggacacagggagaagacctgttgaattcttagttgacactggtgtcacttacttggttctgaacactagatcaggcaaacttagttacaagacttgtaaaactgtggaggtaccagggaaggcccaagaatgagcattcacagagccattagaatgcttactgcttccttcctacacattcccaaataccctacagctctgcaaggaaggaacatcttacataaattgggaagaactatccacctaatgggtgacaaactggagattggcatcccctgaagaaggggtacaggatgataacattaatggctgaggaaaaatctcttaggacagagcaaatcaacctccccagagtaaattttaagttctgagcccagagacaggtgcaatgagctgtaggagccagtcctgaggtagtccatcaaaaagccagatacacatgggccaatcagaaacagtaccctctccgttgggaggctgtgttgagcactgcccgttatactgtattgaccaaggccttcttacaccatgctcatcagcctgtaatacccccagtctccctgtaaagaaatccaatgggaatattggatgttacaggacctcacagcaggcagtgaagccactgaggatatacatccagtagtccctaagccctactccctgctggtcactctaccacccaccagggtctgatgttttgtattaaaattaaaatatgccttttatattcttttagccccagaatcatgagaaaattttgcttttgagtggcaggacccaaacgggcaagaaaaacaatactgccagatggtcctgccctaagggttcaaaaattccccaccatctttggggaaacttgagctaaagatctaaaagatctatatctggaggaggctaactgtctccagaaaagcgaggatatgccctgatcaccagccctactaagggaggcccctgacaaaaatactgtaactaccttgctgataaatgatataaggtggccaagaaaataatctcaaatatcacaaactagggtgacctcacaggtcaaacaaacctactctagggaaagaaagatgccatttgcagcctcactactaaaactggaaaacagattaggtgtttcctggggatggccaggttttgccacatctggatccctaactatggtctgctagctgggcctctgagtgaaaagttcaaagaaaaggatgatgatccttttgagtggaattcagaatgcaaaggggcctttcaacaattgagaaagcagttactttagggccctgtcctcccagatttagttaaaccctttgatctttatattcaggagagaaggggaattgcccttggggtattagttcaaaacccgggaccccttacttgggtagttgcttctgtctctgaacaattagatcaaactgctaagggatggcctccttgcctacaggcagtagcacccgctaccatcctgctaaaggaggctgaaaagttagtgtttggtcagccaatcactatgcagaccaaacaccaggttcaggctttagtaagttctaagggaacagaatggctatctcctgaaaagtcgattcaagctcaggctctgctatcagacaagacagtggttaccacaaaaacttatcataccctaaatcctgccacttcactacccacagaagtggggccctggggcatggttgtatagaacacaatctattccaattaactgaacctagaagatgaatggttcatagacaggagcaattttatgagagaaaaaaaggatggtgggatacacagtgacctcccagagctgtgagaattaacatatgtcttttgtatcaaaggaagccttgcttactccattttgctcctgctttgcctgagacaccctcctccccttttccctctcttctcagcaacagtttcaaatcagccaacagagaagaatgtgcaccctgacctgactaatggaaaggggacagattcaccacctgcattagggataaaaagtgggttcttcttcacatgtgcttgctcatttgtctgctcgtcaccagcggggagcacttgtgcccttctgcagaaagtacagccttgtccagatctccccatgtacctgtgtcttactttctgacactgacgatccgagccaggggtcacttttccccaaaagacctgagtcagagggcatgaaacccacccctagggacttcagcccaaaaggctgatagtcctcacctgagccttggagcatgggaaagggaagaccttaaatgtttacacagactccaggtatgcgtacgccatcctacgcccacatggggctgtttggaagaaaagaggtatgtttactacagagaataagcaggtgaaacatggcttaaacacactgagactcctagaatcaatgcaatttccaaaaaaagtggcagtgattcactgtagggctcattaaaaagggcatacagaggtaataaaaggaaacagcagatgcaactgtcaaaagagtagtcctagaaccagtaacttgttaactaccccttatacctaaaaggccagattcatccaattactcccatctatttgaaggaagaattagacaaagcccagaaatgggtagctggttcataaactttagcttgccaagcctacagggaggctcatcaacgaactcaaactatgcgagggaagccctatataatcagtgagttgaggtcctggttaactcctggcatgaaaagtacaactggttggatagttgagacatgcctcatctgcacaatgaacaacccccacaccagatcccccagaggtccccagataaggctcatttggacatatcctaggggatattggcagatagatttcactgtcctacttaagtactaaccaatttcaggtatctcttggtgctagtggacacattttcggggtgagcaaaagtgtcccctactagaaatgaaatggcagctaaaatggctaaagtcttacaaacagataataacctggcttgggcttctgggactcatacaaagtgacagcggcccagcattcatgtctcaagtgacaaaaaggataatgagtgccctgggcataaaatggaacttgcactcggcctggggaccccaaacattggggaaagtcaagagatccagaccttaaaatgaatcttagctaagctatgccaggagactcaagaaaacgggattaagttacttcctttttttttttttttttttttttttttgtctttttgctatttcttgggccgcccctgcagcatatggaggttcccaggctaggggtcgaatcggagccatagccaccggcctacgccagagccacagcaacgcgggatccgagccgcgtctgcaacctacaccacagctcacggcaacaccggatccttaacccactgagcaagggcagggaccgaacccgaaacctcatggttcctagtcggattcgttaaccactgcgccacaacgggaactcccgggattgttacttctaattgccctgctccactcggtgttagcaccaagagataaagttaagagcatttgaacttaagcatggtagacctattccccaaaccagagaaaagggatactttagcccctttgaaatggaacaacctaagtatgccctcttgtacgataaaccaagaacacgctcatggaatatagtgactgggtgctgctcacacccactgacctggccctccaacccttccagccaggaaactgcgtacatcaaaatgtctggaaaagtggcagccacaagaccagctcattcctaagtggaatagaccccgtttagtgatgctaaccacccaccctgaagctgcaggggatcattccatagacacatcacttgagcgaagaggccctcgagccccaaccgccaaagagacaacttggagcaatggatccccttaattacttgtgtgagcctctctctgatctgaagtgtaccctcaaaagctgaccactaattgcagcaatcttgctctcacagaggtgctagggaccttggacaggggactcttacataacactgtcactataaaaaagctaacagccaccgaccgtagcattggtggtcaatgacaaaagtccattgactcattggctggtatagacctgggtaacccagttgtcctggatatctgctagctgccctggagaggggtctgtgcaccagccaatacgtcacactgcttttacaatgatgcaagtggcctgatcggagaacgtgcagatagactatcaggaaaagccacttggctgtagaaaccaggtcaccaacctggctgaacaaatgcagagcgggtaaaacaggccctcctgagtatcacttggtgtattcctctcctgggccccttaatggccattattctcctgctaatatttgggcctgcatcttaaattgtctggtgtcctttgtccccagaaggttagaattcacaaacccccaaatggcaggcggtggctcagggatatgagcagtgagggctgaggcctgctgacaaacaggtctagaggcggctggggacaacttctgctcggggttgtgacaccggacgcccaaactcagcaggaagcagttacagaagacagacccggtgcccctcagtgcccctcaggaacgaggagcaaacagaagacagaaaggatttgtcacctgcaaagcccattaacaattcccggggaataaagatagcatctaggtaaaaaaaataaaataaaatctaaccttttttttccctctgtgcttcgtctagcttcagcagctcaacgggggcggaggcagaggcctcgcaccaactcttccgggcagagctcctgatgtgcaaatggctgccggacaccgcaccttggcgggagtgcgctccggctgcgcgcgcacctcagctcaagatggcggcggcgggtcgtgtgcagagacgctgcgctccccgctgccagcccgagcgtgagcagctgtgcggtccctgggagcgctgcccccgccccctccctgtggagagatccataggaagcggcccccgcctaccgcctgtccccagagccggggctccagcatgcagctcgccatcctccattgtttgatccagaaatcaaacttccccttgcttctggacccaactcacccagtcggcaccagtgatactgggcaggaggacccttgccggcataggtagtgcggtgtgatgtgtccgagttagttttactctcttcggaggaatggtaactacacatgtgaagaaccctgagaaaacacacgggggtagggggctgggggggggggggtcggggggtagcttaacgtgtgaaatgctcaattcagaagccacattccagagaggttgggttacaggctccagccctctttctagctatcccaggagctttgttaattagcataatgaggttagaaatgatttctcattggtgaaatgagtttcaaatgagtttcaattatgtggattggctaaaaatgttttcagagtactcttgcctcaggataaacaacataaacaaaatctagccagcctaggtttatacactttgggtttctctccatgctccggatgctaaattgtgtcttcagatgtaatgggaggattcttccacctggctctgatttgagagctcaggccttcccccaaactagaatcttgttctctctgcctctaaggcctgtagagtgctgttaggtatctagaaaccccaagtgcctagacttcatcaagctcattaagctggtcatgtgattatttggggcctgattgctaaatatttatgcatgttgcagagtgaggtctgcgacttgtttttgttataaacataccatctggatgtgaggtccctgtagttgtagtctgcctctaattattgaaaggcacagatatctatcaaaaggcaagtaataatagcacattacccaattgaggtgcacttgaaacaccactgaagccccttctttatattcttcatggtctttagccacaaatgcatgcaagtgatcagttgaatatctctaatacttgcatttgttttaaaaatcatttcttaggagttcccgttgcggttcagtggtaacaaacccaacaagtatccatgaggatgtgggttcaatccctggccctgctcagtgggttaaaagatccggcactaccatgagctgtggtgtagttcacaaacgtggcttggatcccacattgttgtggctgtggcgtaggccagcagcttcagctctaattcgaccccaagcctcggaccatccatgtgccacaggtgcagcccaataaataaataaataaataaataattgagagacttcattagataaaagcaaaacactacagcaagacaaaagatatcagaaaaatgttaaaaaaaacaataatctggcagaaaatatttgcaacgtgtaaaaaaatcagaagataattacttataattgcactaattaaatgatgacagaaatgatggttcttaatcacttggagggtgtgtctatctgtcatctacctcaatatcataatttttcctcacttaatgacataatttgaatatatttccatgttattaagtccatttctagacataattgttaatagccccacagatttccagtgtgctgagtgtggtgtacaagttgcagttactgccatggcactgctctcaaagaaagtgatcgggtcactttgctcaaggaccctcccccacctttcccccagtcagggacacagcctcctttaaataaggattggagaaatgattatgaagtggtgacaaattatgagcctgtgtggtgcacccctctctcttgatccagctctgctcttggttcggtttcatcatagccttttatattccttgtttttaagcaaaagatggaaaaacatacaatacatagaaaaaaaccggtaaatgtgtgaaaattccatgactaattttctcatactacaagcagctttctcaataaatatatatatatatcattcttcttgtcaatattttcataaaataacaggaaccaatttgacatataatcaaatgtattaactcccctcctctcatacccttaaacaatactttaattcatggaaaatactacataaaatttttttgaatatttttatttataaattttgaaaaaatttgtttgcaattagagcaaacattttaaaatttaacaactaaaatgaatgaaaattgtttgggtagttcatgatttcaaaagattttttcagataaaatgttaaaagttttacatttgtaacatgttaagtgaaaaaaatatcactaatgaaattaaaatgtattctaaaatattttaatgtctttatgacatagtagtaaattcccttgattaaaaagtagaaaatgcataaatatggaaaaaagaaaaaaccattcaaaatctcacaactgttaatatttatttcatttctttttaatcatttttctctggtaatttcctctcttctatcttcatgattattattacattgcatatacagtgtaatttcttcatttttcatgtgacataaaataatacatttttaatagaattttaattctaagaaggatctttcatccaaagaatgcacatttaagatatgacccttctaccaaacagccagaaacaacaccggtctgtaatagatatgtttataaatgagtccccgatcagtacagaaccttttaggaatttagagaagacatttggataacattatgcctttcagctctgttcccaatggcaaagagaatggcttttggcagcctggcctgtgatatactgccaatcaccagaggcaacgcctgatgattaacttagaaaatctcattacttttgactgatagaaaagaaaagggatagt

SEQ ID NO: 210 - DNA, 10008 bp, artificial
  ss1863 sequence
tggactctaggatagacatttacaaccagccacctatctatactacagcaggatagatagaaataacagcaggcacaaggcaaataactggtacctgtcttctgtgaacttgttaaacaatggggatgataggaccagaagaggggctgagctctgcttgcgaaaaggaactaagaggtcacgtacttcccatcctcaggatcactgagaccccaactacacatgcgcagagagaccctctgggtcaaaaagggagggggtaaccaggccacaataagcctggattaccttctcaccatgctttgctttggaatccatcttggccaaaagatgcacatgcagatcagggaagggccccagatctggtcagatgtgaaagataaaacaagttaattggccaaagacagaaaaaacccggaagaattgtcctacataagtagtttaaatcacctttctggtgtgctcctcattctgagggggtgcttgcaccctcacttctcctttgggtgtgtattactgctttacttctgccttagctcaatagactaatactgtgtttctgtgctctcccacattgttgtactgtgtttctgacaataaactttatacctgtttttacagtctttgcctccttgaaacattcttactttcaacagggggtaagaatcagggcaattctacttctggcctctagctggtctagtggctaggatttcttgttttcatccaggctgcccaggttcaattcctgagcagaaaactaggatctcgcttcaagccatcagccattactgcctctctgaaatcatttggccaagagcttcaaggtagattgctgaaaattcgggagttcaatgtaaagtccaggtcttgctcagctgcctgtggcttgacacctcctcctggctttatcctgactctttctcctgctgtcttaagtactccttgctctcactctctgccttgtttcctttctaagacccacagggcataaactgggtccactcattgtgtaacggctccccttaaagcttaagggtggcaggggttaatttccaggtcttgcagatccaagtaacacttgggtggcaggtgacgttcttgggaccttgtggaaacctgatttccaaccgtgcaggagcccaaagtgtctctctctctttgcttctctctctcggtctcatatggggtcatcttctgcagctttccttcccactttgcttgcacagcaaggtttctttttcatctcatattttcatgcatttttgggaaaggattttctggatctcactcctaaactgaggccccatagctgcaggagttattgctgtcagcatcaaaggaagtccttaagtccttttcaactttatcttagcagccaccaagagaactgggaaatggacttggggttcttttgttgtttaatctctcaccttattttatgtccaaaattctcttatggtacttctacctcgcggccctcagtccctgacccctgtgccacttttcattgtacccaactccatttcctccaggagttcctttatacacctctgagaccccctttacttcaggcttcagcaacccatatgatgttatgaactatttattgtgctggtcacttccatgcagcccatatcttgttttatagatgctcttttatagatgttcagtgcatgcaaggaatacacccagcatagggaaacttattataggacataagctttatagacaacagatccccatgccccaagaacatgacagtgactctgcattgtcctgaatatcctcctcaggcagaatgagcaaggtgttaaggacaagggcgaccagagacgtctattcaggtacagatgggggagtagaggacgctccaaaccccatctgcaactagaatctgggagggaattcaggggacaccctaattacccttcaggcatcttctaggtagtgtttctagggcgttggacttcatttctaggaggaatatttattctcggttgcaggttactcagtatgggaggatctccttctaagccagcagaaacacctctggaattcatccttaaaaactggaaattctttaagatagatgggctggaaaaggaaaaagttaaaaagtatcctaacaccatctggcctttatacaaactgggaaatggaaaaaaatggcctgaaaatgggtctctaaattataacaccatcttgcaattggatctttattgtcataagatgaaaaagcgggctgaaattccctaggtctaaaccttcatggtcccttatcaaaatcctactttatgcaatcaaaagcctgaggactcagaaaactctcctgacatttaatttatttattttattttatttttatttttattttttgcctttttagggctgcacctgcagcatatggagattcccaggctaggggtcgaattggagctgtatctgctgtcctacaccacagccacagcaacgcaagattggagtcatgtctgtgacctacaccacagttcacagacttgccagacccttaacccactgtatgaggccagggatggaacccacggcctcgtagttactagtcgtgttcattaacccctgagccacgatggaaaccccttgtgagattttagataatccccttctaacttcccccaactctcaggggggaaaccaagcctcacctacttttctggaaccatctacgtctccagatccctctgactcaccccaaacttcacctccctgtgtccctttatatcctccattatctcaggaaggagtccctctggagtaaccctctggtcacaggcatggctccaatcttgcgttgctgtggctgtggtgtagaacagcagatacagctcctgtcacccgggagcaggaaatacatgcccttagcgaagtagcaaatggtgaagggacagttagagtgcacatacctctctctttaatggatttagcccagtgcaaacagaaactgagctgattctctgaagaccctagcaaatttgctgaaggtttcaggctctaactctggtcttcgatttaacttggaaagatgtccaaacagtcctatctacccactgtataactgaggaaaaacaaaggatctggagagcagcctaggcccatgctgatctgcttgccagggaccagcccatccatcgtgctgtggacagaaatgcagtcccgaatcaggagccccattgggattataatttccaagaggaaatggaagctagggatcacatgatccaatgtgtattagaaggaatgagaaaaagttaactatggaaagatcaaagaagtgacccaagaaaaggatgaaaacccagctcttttccagggaggcttttagaacattttctaacattgataacctctactccagagagccagacactactaagacaacactttttttttttttttttttttttttttttttttttttttttgctttttagggctacacctgcagcatatggaggttccccggctagacgtccaattggagctacagctgccggcctacactacagccacagcacgcaggatccaagctgcatctgcaacctacagcacagctcatgacaacgccagggccttaacccactgagcaaggccagggatcaaacccgcaacttcatgttcctagtcagattcatttctgctgcaccacaatgggaactccaggacaacactttattagccaatctactcctggtattaggtggaaacttcaaaaattgaaattaggcccacaaacccctatgtcccaactcttaggcccacaaacccccatgtcccaactcaattattaaataccctttggggtatttaataattgagatccagtagaggagaaagagagaaaccagtgcgagaacagacaggctaaaactcatgttaaattgatagctgttgctgtctgtcatgccctgtaaccccagggcaacccaagggggccaaaagaatctaaacatctgcctgaaaatagggctaataagtgggaatgctttaaatatgagacaactggccaactttgccaactgcaggcaaagaggtcaccggaagtgggactcttcccagtcccagaaagggagggggactcctgctcctgagatggccatgttggacaattgaggctgcctggggattctggtggctctcctcaatgagatgtccctctccatgggggagccccgggttgcccttgatgtggcaggtaacaaaattgattttttaattgacatgggagccattttgtcctaacttcttatgctgggcctctctcctccaaaagctctacagtaaccggtgttgacggaataccttgcacccattacttcactgggcctcccacttgccaatttgaacagcgcctgatttcacatgcttttcatttgtgcctgtgtcctacccccactactgggaagagacctcctgggctccctcggggccccattaagattaagaggtcccaaacagccccttatcttgactataaggcaagccaggtagaagaaaaaaggcccattctcagccatatttgacaagcagtgaactctgcagtctgggaaaaaggagtccttggaagggctgtaactgtccagcctgtagaaattagccttaagccagaagcagcctatcctaacaagagacaataccctacaaagttagaagctaggtagggcttacaacactttctagacaaactcttaaaatggggcctctcagtgccctgtcagtctccatgcaatactcctattctgccaatcgttaagccagctggataatattggatggtacaggaccttagagcagtaaatgaagccatagtccctatacatccccttgtggcaaatctttataacttattaccccagattattacctggagatgcccagtggtttactgtactcggcctcaaggatgccttcttttgcatcccacttcatccttcctctcagtatccgtttgcctttgagtggaccaacccccactcaggccaaatggaacaacatacctggatagtaccaccccaggggtttgagacacttgtttgtccacacttgtttgtccaagccccaggaaaagtactaagggagacatagctaaaggaaggggctattctacatgtaaatgatatattaatacatagcccttccatagagttctcagatcaaaatacttctgaagtccttaatttccttgggcctgagactacagaatctcccagaaaaaggcacacatttcaagctaacaggttaaatatctgggatatattataaaccctggaagtagacaagtaactccagatagaaaacaagctatactatccctagatgccctaaagacaaagaaacatctttgcacctttttgggtacggcaggtttctgtagaatctagatcccaggatttgggctaatggctaagcctctatatgaaaccaccaaaggcccagatatagaaccattactttggacaggagaacaagaaagggcttttaacaatatcaaacaaaccctcactagttctcctgctctgcatctccccaacttaaaaaagccattcttcttacatggagccaaaaagcaggggatggctctgggagtccttatacaaaaactaggagaagtgcatcagccataggctatttttctaaactagattccattgcccaaggttggcttggatgcctctaggcagtagctgccactgctttattagtggaagaagctaacaaactcacctttgggcagccactagaagtctggacccctcatcaagtacaagggattctggagataaaaggctaccactggctaaccagaggctgtcttactaagcatcgggccttactcctctatgctccagaggtaactctcaaaacatgccatatcctcaatccagctacactaatgccttctgaaagcccaaagctaatacattcttgccttgaaacccttgaccaggtttatgtctatagacctgacctaacagatcaggccatagacaaccctgaggaggaatggtttactgatggcagtagtttcattaaggatggagtcaggagagcaggatatgctgttgtgagcactcatggtgttggtagaagtgaagactttgccagctaacactttagcccagaaggctgaactgatagccttaacttgagccttagtcttaggagaaggaaaaattttaagtatacatacagactctaaatatgcctttcttattttacatgaccatgcagctatctggaaggatacaaatacaaaaaattctcccataaaacatggagctgagattctaccttttatagaagcagctcaaaaaccaaaacaagtagcagtcactcactgccatggccaccaaaaaagaatttctctgattcctcaagaaaacagccagatggggaagcaaagaaagcagccctgatgcccataacagaaatggctttaattccatcctttatccctcctgatgttatacccaggtacttagcttctgaagagacccaggtgcaagacagaggaggaactgagggaatggatggctggtggcatgtagatcagaaattgcttgtacctctttctgaccaatggaaaatcactaaagggctacatgattctctccatctggggagagatgcattatctacaattgactttccactttttacaggaaaagtgcttctggatacaaacaagaggatcacttgagactgtaccctctgtgccacccataatccatgaggcaacctcaagcctctcccttttgttagcccagtccagtaacgtaggacttacgcaggaaaggactggcaaatagatttcactcagatgccctctgtccagggcctcaagtacgtactggtttttatagatacttttcaccagataggtggaggccttctccaccagaacagaaaggacaacagaagtggctaagtcacttctgaaggagattattgctaggtttgggttgtctcttcacctccaaggtgacaatagaccttcgttcatagtaagggtcaaccaacagctctcacaggctctaggaattaaacaacacctccattcgtcctggagacctcagtcttcaggaaaagtgcaataggctaatcatactctaaagaaaaccctgagcaaactctgccaggaaacatcagagccatggtatcgtttgctgccaatagccctctctagggttagggtggcccctaaaatgactactaagttgagcccctttgaaatgatatatggaaggccattcctcattgtggacatgctaactgacccagaaacccaagttcatcttaaatacattatagacctaagccaggtccagagggctatataagaatatggcaacgaagttcagccttctccagacaacatccccagccagcctattataaaccctggggactcggtgatcttaaagacccaggaaaaatgactctcctggtgaccagctgctcccaaaatggaggggtccttatcaaatcctgctaagcactgctacagcagttaaactccatggagtgactagctggttacatctgtccagagttaaacctgtctctcttgatatgttatagaaacctgaagacacacagtccagccaaacctgtggatctacctcgtctcttgttcttcatcagacacagagtactttgaacagcctgaaatgtttaggtggataagcgagcctctccaagacctgaagctcctattcaagaaagacagaaaaacttcataaacccaggctgagtatccacagccactattttcttttagcctcccagtgctctggtatacttacaaaataactaatatgcactggtaaatttgggtaattattgtcctttttggtctccttgctgctggaattttctatgagtgctgcaatagcccagcacccatacctgagagaatcttctctgcccatgctgggtgatttaatgtaactcacctaagactcaaaactccatgcttgattcacttcaacatttcttttaccatttctttgccacctgccttcaagatcaaaactctgattggtaccataatgaaactattaagtgcttcagcttttctttgtctcccccctttgtctataggatggacagacaacttattagctcacatttctcaaacttttgcttcctccactcagctgagtgctggatttgcttgccccaagccaagtctcttgttgaccatagttacccctttgtccatcctgaagagatttcagccaagttcccgagggaaactggacttctaccaaagacccagactcaggatggtaatgtacagagtcagaattgctcatttttctactgaagaaagtactaatgtctcttgccttacttttcccttagcggccaaaggaaaatataaaatcaaactctggggatggcaaattattatagcaccccagcgttttacaatggttctccctaagccagaattccagctgcctgtttgttctcaaactctaccttgtcatccaatagaagaaggatccaatctgggttttggcctggttaatactgtcagttttagttggagaacatttccgtaacaataggattggatggctaggtatataagaccttgggcaaattagtctattgtgtcctatcaggctacattttttcatatgccaggtagataaaaaaaccatgggctactaattgcctatgaaataattttacatccacacagtgtatggtgggaactttaattacccctttctcaagtcattctgtaaatgaatccaagaactgggctagttcattagagctgttcaccgattaactcaaatttcctaatggaatcccagatggagatgtctattttttcggatgtatgttgttaccatggtggcagatagctggccaccaacatgtccttcagaacttgtactctccttagcacagccagtgagactgctaattctcttactaatttacagaggtctctagattccctggtcaaggtgggacttgtcaactgctggctcttggcagaacaaggaggggtatgtgcaattgccagtataccttgttgtacatacattaatacctctgcccaggtagaaaccaacagtggaaaaaatccaacaataagccacctggcttcagctgacatttaatcttcaatcccctctatttgggctgaggaattgaaaattggttctctagtttattctcctggatcccataaggtataaaaactttctgacagcaagttatcagtttctcatagccattctcttttcagtcatactggtttatgctgtatttcgcctagggctttgttgtcttccttactgttacaaatctgtgactaagacttatcgatccataagaagaatctgggaccatcaggttcaaatcttccattttaaaaatagagagaaccatgttaaactttaggactaacaaagttatactaaccacacatgatataacctgattgtactaattataatatctttactaatccttaactcttgcctcatttaatttacttatatctagggcacaacatttttttccttagacaagatgacagtgatgcagagatgctaccggaacagatcctgctgaaataactatagaagtcaccctggggcctctgataagatactgcgagagctccacggccccagttaggcagggtctacaagcctctagctagcctgaagaaactacagaagatggaccttggcccttcatctccccaataaaaatttttggggtccacgtctctcaggggggatttgaggcaggagataaatgggctccaggatagacaactgcaacgaaccttgtatttacacttcctgaggcaggagatgggtggactctaggatagacatttataaccagccacctatctatactacagcaggatagatagaaataacagcaggcacaaggcaaataactggtacctgtcttctgtgaacttgttaaaca

SEQ ID NO: 211 - DNA, 3637 bp, artificial
  ss1871 sequence
ctaggatgctctgcatagacagctgatgccaagcttcctcaaatgctaaggattgttaaatgcctaaaggtcagaataaaagcttcatcagcacctggctctgtgacttttaaagtaacttaccaaaacctctatcctgcacctacaacccctttctcacttgacagtcatcctaaagagcacaataaaagcagtgtggtttctggaggcgatgctcttggtccctgagacctggagtcccccagttcccacctgtgtcttgttttatgttaacttttttcctcaagtttcacagcacccgttcttcagccccatcctgctgagctggtcttggcaagtagcgcccaatacggggcaggcacaaggaacgaaggaccaagacgacagcggatttttattcactggaagtgctgcggagccctgagaagaagggaggaattttgcatggccacgctaaaaaaaatcctgcagatacgttccctctctcaggtatttacggggtaacatgggaaataaggtaatcgcaggaaactgtagtccttacatttgtttgttaggacaactccttaaaaaagggggtgcaaaaacaagtgaaagtaagcttttggaactttttcagactattgagaaacattgtgattggtttcttacattagaaacgttatatttaaaaatatgggaaacagtaggaagggaacttaggatattacatgatgagggcattccaattcctgtgtccatttggagtccctggagcttaattaaatcagttttagaacatctacagaccacggaggacttggaggaggaggaagaaggggagtttacccctttgttggaaaaacctaaatatgcagtctctgaacaaaattatcatagagaatatttggctccaatggttgattctgatattcctctactgcctattaggagtgaggtgacgaggactcatcaagcctctacttctagggttgcaaagaaaatgagcattttccctgaacaccatctaccatccattcaacagggaattttacaggctccaacgggaggcaatttggacgccatacatcgagcctttccagtaactgtcagggagacagtggctccaagcattgatcccgccaaccctggtggagtctatgagttcattcatgagccctttcctcttacaattcttaaagaattaaaacaggccgttcaaaactatggtgttcattctccctttacaaaaggaatcatgcagggagtagctgaaggaaatcttatgattcctgctgattggcataactcaacctgtgctgtgctactgcctagtgaatatttgcaatttaagtcttggtggcaagatcatgcccaaactactccaaattgtaatcaggctcgaaatcttctgataacaaaggaacaattgttagggattggtccttggagtgatcttcaagatcaaattgagaatgaatcatttggctattgaacagattagacaatgttgcttaacggcatggggtaaaattgaaactaagggtcaaataaatacttcttttcaaaagatcctacaaggccctaaggaaccttttactgaatttctagctcgtttacaagaggcattaaaatgacaaattactaactctgaggtgtctgatactatttttcaattgttagcatatgagaatgcaaatactgattgcaaaaaggccataggatttttaaaagggaaagctaacattgccgagtatattaaggcctgtcagggagtggggacagagtcctttaaggcctcaatgccagcccaagccatggctaatttaaaggttaaagacaaattttcagaaaaacgttttaattatggcaagacaggacatactaaaaaacaatgtcgcactcctccacgagcccgaccttcctttcacggagctgcggcaccttctaggaacaataataagcagcccagactatgtccaagatgtaataaaggaaatcactgggctagtccgggctggtccatcttccataaagatggaacccccttgttgggaaactctccctggggcaagcttccagccccatcaaccaaggaagctttcccattcagaacaagagccaaactctcaaccgatgcaagattccctgggactacgctctgcacgagcattcaacatcacagtagctctccctagcttacaggatttaattctccttcctagtgaaactcccacttctattacaaccgaattgaaaaaaccgtcaccaacagatacagtaggatcgatgataggaagggcagggctaacagaacaaggagttcgagctcacacggggatattggataacataggggatgataaagtacaggtgatggtttccactgcgattccttggaaaattaaaaagggggatcggattgcccaaatcttaattttacctagagtccagaagaaaaagtagaggaataattttagacagaaaggattcaattaccacaggaggggcaggaaaaggtcctagaggaacgacccacttgtcaagttatcataaatgggaagtcttttagaggggtgattgatactggggctgatgtttgaatcactagccatttacactggccagacacctggcctcttcagccagccgatatattgaagtcactgggttaggaaaagcagagggtctcagaaagagtgcccaatggcttaattgtgaaggacaggatgggcagccagctagattgaattatgttgctcagctccctatcaatctatgggggagagatttattacagcagtggcatgcagaaatttacttaccaccagtagatcaatatagtcatcaaagccaaaagatgttacagcaagagggttacattcccagacgggagttagggcgacatcatcaggggagagtggaacctgtcgcatctgaggttaaaatggacaaatctggtttgggacatcggccttttccttagtggccactgcttgcaaaaataattaagcttctcctgaacgtattcgattaaaatggactacagaaaaaccagtttgggttgagcagtggcctctttcttcagaaggattaaaggttttaaatgatcttgtccaagaacaattagagaagggccacacagaagaatcctgtagtccttggaattcgccagtgtctgttatacagaaaaaaatcaggaaaatggagattgtcaacagatttaagaggagtaaatgctgtaattcagcctgtgggtgcccttcaaccaggcctcccatctcctagcatgataccagctgactggctgctaattatcctgggcttaaaagactgctttttcacaattcctttacacccagaagacagggaaaaatttgctttttcagtgccagcaataaacaatatagcccctagaaagcgttatcaatggaaggtcctgcctcaacgcatgttcaacagccctaccttgtgtcagtatcatgtggcttcagttgttgagccagtccaacaacaatttcctaaatgctctactgttcattatatggatgatatactttgtgctgcaccctctcgggagcggctgactgaggtttttcaatgcttgaaatcctctctaaagggagcaggattggtttttgctcctgaaaagattcaa

SEQ ID NO: 212 - DNA, 6641 bp, artificial
  ss1929 sequence
tgattgtcatgaaggacataaacctgggccctgttaacattccacagctctggacacaggcctgggccttgttgacattccacagggccggtgtaaggcaatcagcccagtacctaagtctccagccacagcccccttttcctgttagaactaagtgagctgataagggggactgcacaggctacaaggttacccacctaattgcctctctagtgctgacataagctgcttgcttgaagttggaagatatgaaccttactacaaatcattattgtaaactgaaacactctcactagttaagatgtaaagtattttaaccaccactttgtttttggcacccctccttaggcatgcgcaccccctttccaacctgaatgtaagtttgcctttataaacccggtccatatctttgttcggggcttcacactcaagccacttgtaggcagtgtgtggccctggccagtaataaagactccttcctaatttgtttcttctcagttggagtggtctctgttctttcacggcacaatatttggaggccccagcgagacacagaccctccagcttttggaactcggacgcctccagatcagcgtggggaagggggtcccttccttaggaggcgcacgccctgatgatgttccagggccctgaggaaaagagcacccgagctcctctgtgctgatcccaggagacgagcaacttcaccccagaattagaaaacggagtctcctggtctggaaatcctccggaggtaggtctggtccgcgatgcgtttctgggggcaggggaaggccagacgcggcatacttccttgcccagagaccggagcgagatgtcgcccagcctcacctggttacctggttcctagttatctgtgtgactcttttaagcgtgggtttttgtctccggagtttctgtttgtgttgtctgtttgtgttttgtattctgtgttaaaaacgttctctttccacggataatatttctttcttgctggttcactggctctctttcgccttctccctgcagcggtgtctcttgctcccctgctgtctcctccgggcactctgcttaacaaagctcctttccctttcgctttaacccttcacctcctccctcacaaaaggactctctgcgaacaggtgaatgacggtgaaagcaattgaagggctccagccagggctactccctggcgggccccgaaggcatcaatactcccgcctccatagctgtcgcctggaagggtgagagtctcttcttctagcaactgaggactaggccgaataaacaccctgtgggcacgggtgaggcacttaaaagtcgttagggcgcctgccacttagactcccgtgaaaggataaaggggtcacggaatggaccagaccgctaaggtttctgcccccccgcaagaccatttccgtgcaacgtgttaggaacatagtggtttaagcaaaactctttgcccgtttcctctggccaccactgtcccccaccccataggatttgggtggagccctcagcccttcttccagattttaactgctctctttttttctcatcccccagcctcgggggatggatgtttttcttatcctgtatgtcccattcatattaataatctccatcggtctagctgctactgctatgggcagcccccgacctcctctgctccctctcctgattcatcctcagctgcggccgctgattttccgctcggagaggctgcatcaggagacacgccgggagttcccttcatggtatatgtgcccctctccacctctgctctctataactggaaacttcagaatccccctttctcataaatgcctcaaaatcttatctccctgcttgaaactctcttctacacccatcaacccacttgggaagactgccagcagctgctccagactctttactacagaggagcgggaccagatcctggcagaaagccgaaaagcaatccaaggaccagacggaggggcaggccaggagcaacatatcgagcgttggttcccctcgcaccgccctaactgggaccccccaactcgagagaaggtaaggaggctctagacaactatcgccagtttctgctacagggactccgcgctccagcccggagacccactaatctctctaaggcaagcaaagtaacacaaggccccccgggaatctccagctgggtttctggagcgcctcctagaggcctgtcgtacccggactcctataaacccgatgctgctgagaaccagagggctataaacattgctttcgtttctcagtcggccccagacattaggagaaagctacgaaagttagagggatttgagggtatgaatagggcccaactcatagagatagcgcagaaggtgtttcataactgggagccagaagatgaaagaaaactaaagaaggaagtacgtagggtggtagccacattagagactaaggggaccaaaaaaccctcaaggcctcaagctaggtcaaaaagggctacacctggagttcccgttgtggcttagtggttaacgaatccgactaggaaccatgaggtttcgggtttgatccctggccttgctcagtgggttaacgatctggcgatgccacgagctgtggtgtaggttgcagacgcggcttggatcccgcattgctgtggctctggcgtaggccggtggctatagctccgactcaatccctagcctgggaacctccatatgcagcgagagcggcccaagaaatggcaaaaagacaaaaaaaaggtggggggctacacttgagaaagactggtgtgcttattgcaaggaaaagggacactggaaaaatgaatgtcccaataaaaaggggagagaaaaagaaacccatcctgactgtagaaggagaagaagattgacggggctggggctccatatccctaagcttccaggagcccatggtatctttaaacataggtggcaacaaagtccggttcctggtagatgcaggggcagcccattctgtgttaacaaaacccttgggaaaaataaaagaacagacctcagtccaagcggccactggaaaggttgactctttcccttggactgccgaacgaactgtgaacctaggaaaaggaagagttacccattcgcttttggtcatgccaaatcgcccatatcccctcctgggctgggacctacttcataaactgaaagcaactatatcttctgagtcagaagaagctaaactaaatttggtatggcccacaaaggttttagttacttcagaggaatactgtttaaaccaggaaccccctgatattgacaaacaaaaggactcttatttacagaaattgctacaaaaataccctgaggtatgggctgaatcaaatgcccctggactggcaaaacatcaaccccctgtggttgttcaactgatgagccaagccaccccattaagggtgagacaatacaagtcaagaagcccgagtaggaataaaaaagcatattgattggttaatggaggctggaattttgatctcctgccagtctccctggaatacacccttgctcccagttttaaagtcaggaaccaaggactaccagcaggccaagacttaagagaagttaacaaacgggttgaaactatccgccccacaggtcccaaccctatgccttgcttagcctgatacccccggaacaaacaatatatactgtattggacttaaaggatgctttcttcagcattccactggctaagtccagccagcccatttttgcctttgaatggtccaatcctgaaaagggaattaacggacagctcacctggacttggcttcctcaggggttcaaaaactccctgactttgatgaggctctggcctcagacctatagtctttcacgaacacctttccccaggtgatgctcttgcagtatgtggacgacttcctgctggcagcagaaaccaaagaggcctgccaagaagctacagaaggactgctagaagttcttcaggggcttggatatcgagtttcagcatgaaaggctcagctctgcaccctccaagccatccacctggggtctgacctagaaagaggtaagcgcaccctatctgcctcttgggtctctgctatcttaaaaattccaactcccacctcaaagaaacaggtgcaggaattcctgggagcagtaggatactgccgcctctggatcctaggttttgcagaactggcaaaacccctctattctgccactgcgggggaaacacccaattaatatggacagagactgaacaacaggcctttgaaaacctacaaaaggccctaacatcagctcctgcactcgccttgcctgatataaccaagcccttccacctatgtatagatgagaaaaaaggcatagctaagggagtattagtacaagctttagggccttggaaacgcccagtggcctatctctcaaaaagactggatccagtagcctccaggtggccagcatgcctacgtgtggtagctgcagcagctgtcctagttaaggaagctgataaactaaacctgggccaggacttgctcctcacagccccacacactgtggaggccctcctaaaaggaactcctgaacgttggttatcaaatgcgcggctaactcaatctcaggccttgctgttagaccaaccgcgattaaaattccataaattgacagctctaaacccagccaccctcctaccagatgacaacccactgcaacctatccacagctgcgtgggagtcacaaccggtctacgaggactgcgaccagacctgagtgacattccactggcacaacctgaggaggtattctttatggatgggagtagctttaaaaagcaggttgtcaggggctgtagtcatcagtaaggagggagagataatatgggctccgcctttaggccatgggagttcagctcaaaaggtggaactgatcgccttgactgaggccctgaaaaaggcaaaaggaaaaactgttaacatttatacagacagccgatatgcatttgctacagcacgtgtacctgggagcctctacaaggagagcggtttcttaacatcagaaaggacattaaaaataaagaggaaatacttggcgacagcaaaagcccattagcgaaaagctgttggatccgtacctcctcttctccaggcttaacgcctattgaagattctgaggccaaacattcactaatttaaacttgaccactccagactactccctaatgggcccccttcctatccctaaaaaacttgctagatgttatgttcaaaagggctctattcccttaaagggacggagagtatctttgatgcctctcactgtaaccagactgctactgtccctaaaaaatactccctgtaccaccacagagaaactcgttcaatgtggggatgtactatatcgttgcctccccaaagattgggatggaccaggcattgtagtctgggcaatcctggatgtgtccctcgtccctggtaaacaagcaattcccattccagtatactgaggggctcatcggaaaagatgaatcaagagggtgtttcccctcttgattcctcttgaggcagccctgggcgtcacggcaggagtaagcacaggagtggctgggatagtacatagcaaatgcctgtctgagcaagtccagggcaacctggacacggtcatgttgacagtactttctttacaagatcagttggactcattggcagagttgtattacaaaataagaggggcttagatctcctaacagtggagaaaggaggtctttgtactttcctgggtgaacaatgttgtttctacacaaactaatctggcatagttcgtgatatggtaccgcagttaagagatcaggtaacaaaaagacaagccaggtataaaaataattggtaatggggcagactttctggatggctcccctggcttctccctatgataagcccagtagtcactatagcactaattttactttttgtaccttgtctcctccgatgtgttactggctttatacaaaaccggataagagcttttactaaccagaccatctcacagatggtcctgaataaatatgaacctatgcccgacagtgaatcaatgatttgactcaaaggaggtaaataaaaccagtggggaatgaaggacataaacctgggccctgttaacattccatggctggacacaggcctgggccttgctgacattccacagggccggtgtaaggcaatcagcccagtacctaagtctccagccacagcccccttttcctgttagaactaagtgagctgataagggggactgcacaggctacaaagttacccacctaattgcctctctagtgctgacataagctgctgctgaaagttggaagatatgaaccttactacaaatcattattgtaaactgaaacactctcactagttaagatgtaaagtattttaaccaccactttgtttttggcacccctccttaggcatgcacaccccccttccaacctgaatgtaagtttgcctttataaacccggtccatgtctttgttcggggcttcacacccaagccgcttgtaggcagtgtgtggccctggccagtaataaagactcctgatttgtttcttctcagttggagtggtctctattctttcaccgcaca

SEQ ID NO: 213 - DNA, 3203 bp, artificial
  ss1959 sequence
gaaaatgcaaataaagaccgtaagagggcaatggcccctgtaagaaattcagtaggcatctctgattttattaaggtatgtcaaaatgtaggaagtacaggttatgctcaagcaatgatggctgtagcattgaaaggaattcttagcctctcaggaaagaaatgttttaattgtggaaaagcaggacatcttcataaagaatgttgagctcaattaaaagggaaatcatccctagcaacaggatcatctccaggacctagtaataaccctggtttatttcctcattgtcagaaaggaaatcattgggctaatcaatgtcggtctaagtttcacaaaaatggcagtccattaacaactccagtgtcaggaaatgggaattggggcctgccctggcctcatcaaccaataagggcatttgtggctcaaactgatcttaagataggaaagagttgccagaaagaaagggcaacatcaggatttggaagttcagggacttctcaagtcttttggactcaggaaatcacaactgaacatccacaaatgactattaaggttaatggaaaaagtaaaaggggattaacagatactggagccatgtttcaggttatttggtacagtgattgccattttgcatggcatttaattaattacccccaaaatgaagttgaggggattaggaattctgactatagtccatcaaagtcagcagatgctttcctgggtaggaccagaagaaaaacgggttattttaaaccttatgttgctgatatacccgtcactttacggggaagagatcttctttctgctatgagacttaaattaacaattgaggatgtctattgtggcaattctaatgattcttcccctggatggaaactaatgaaaaattaggatatcaaaaacaaacaggcttaggaaaaaataatcaaagcatagaagaacctataaacttgcccattaagcttgataaaacatggaatagggtttaatgaggatttttaaatagggaccattgaaaattctccactagcccacgcagatcctatacaatggattaatgatggtccaatttgtgtagataaatggcccctaattcaggagaaattgactaaaatacatgagttaatagcccagcaattgcaagcaggacatatggaggaaactaacagcccatggaatactcctatttttactattcctgaaaaatcaggtaaatggaggctattacatgatctaagagaaattaataaaacaatgtatgctatgggagcctcacaaaaaggcttgccttctcctaccgaaattcccttagattgggccttaattgttatagatttaaaagattgttttttcaccataccattagcctctcaagataaatgtacatttgctctctctgctcctgctttaaataacaaagcttctatgaaatgatatcaatggaaagtattgccacagggtgtgaaaaacagccctaccatgtgccaaaaatttgtggatagagccttagctcctgttagacttaaataaccatggatgatactgtcttctctgctccaaaagaacaagtttttaacatcttgctagataccaaagtatatcttaatgaaaagggggttattatagccccagataaaattcaaaagacccctccatttcaatatttaggaactttgatagaaggccatactattcagccacacaaaatgcaaatttgcagggaccaattgaatacattaaatgattttcaaaaattactgggagatattaattggctacagccttatttaagaattactacaaatcaattaactcatctttttaaaacattgaagggtgatcctgaccttacctccccacatacattttctcctgcaaccctcaaagtattacagccggttgaggaaaaaaataaatgaggcgcagttgcaacgtattgattatgataatcctattattctggtcatgttgccttccataaattcacctacagcagtcctagttcaagaaatgccacagtttggcattgtcaaatgaatccatctttcttatcaagaagtaaaaacagcaacactttatgtggacctcatagctaaaacaattatccaaggcatacgccatcttaaacaattgattggagcggatccaaatgttatacgtgtccctctagacaaatttatgaaagaaactttattccgaacctcatcaccatggcagactgctttatctggatatacaggggaacatgataatcatccacccaaaaaataaacttataaaattctacaagagaccttttttatatttccaaaagttaccagatcacagcctattgctaaagctcttacttattttactgatggatcttcaaatggtattcaaggtccaaatactactaaaattatacaaacttcttacacttcagctcaaaaagcagaactagtggctattcaacaagttttaaaaataatcttgtatccttgtaatattgtttcagattctcaatatgtgatacaattagtacaaaaactagaaacagcaaaattgaaggaactaaatgatgagttattccaactggtttttttttttgcatgcaacaaattattagacagagaacatcaccattttttattactcatatacattctcatacttctttatgaggtcctttacatgatggtaatcaaaaggtggaccagcttatcacttctatttttgaaactgctcatgcttcacatgcacttctccatcaacccacagcaatgctgtgtagacagtttagtctgtcttgtactgttgtccaagatattattaaatcctgtccatcatatgaaagcttagcccaagtgtctaccaatgatggagtcaatcctagaggactaaaaattaatcaattacggcaaatggatattactcacagtaatagttttggtcatttaaaatttgttcatgttactgttgacacatattcctctgttctttggacctcagctcaggcaggtaagacttttcgacatgtcaaaaatcattgtgtggaaacttttgctgttttgggctttccacagcgtattaaaactgataatggtcctgcttatgctagtaaagcttttgctgaattttgtcaaatttggggtattttacatgttacttgcatcccttataatccccaaggacagctatagtagaacatgcacatcataaat

SEQ ID NO: 214 - DNA, 7456 bp, artificial
  ss1961 sequence
tgctgtattatcactggcaatgcccattaacaattcccgggaaaataaatagaatctgggtaataaaataaagtctcacctttttttctttccctttgtgcttagtctagtttcacttgctcatagggtgccatctgcagaggccttgtacctggccctttagaccagagttcctatggcaaaatggctgtgcccagcatctcatttcaagatggcagcagcaggctgttagagagagccttggcagtcttgcctggtgtctcaccagtagtgctgccatctttacccctgtacaagtcagtaagagcctcactagggctttttgctgtcttcatcgatttcctaagatcaacagtaacatgccccatcattactttcagtttgataaagaaaagtttggtcagccgtgtgagccaagaagcaagactgggaaaaggcccaggtaatgaggaccatctgacaagatgaagtgaggacactgaatctgagttcaggaaaaggcaccgggggtacctgagtgcaaaagggccccaacgtaggtaggcaaactgtgacttgacatttttcagtgttagtttctccgaagtaggctggggaacctcagtaccaagaaccccattattgggaaatcctgtgagctgtgagggagaacaagaaacacctgctgcctgaccgttcctcccctctctacttgttgaggcaaaccttgggtaattctttttctttctttcttttttttttctttttagggccacacccgcagcataggctaggggtcaaatcggagctacagctgccggcctacatcagagccacagcaatgccagatccaagctgcaactgcgacctacaccacagctcaggtcaatgacggatccttaatccactgagcgaggccagggattgaagttgcatcctcatggatcttagtcaagttttttaactgctgagccacaaaggtaactcccaaccttgggtaattctttatctcacctggcaggagtcagaaaattcctcctttttggctaaaagagaagacctctgtttcagacggttgtatgactccctactggctcaagttactcaagaactaacgtggctaaactgctctggcctggaggcagtcctgcctaatctccttggcatattctgactgagaaaggactacgatttcgggggaggggggcaattatgacagagtccatgatatttgggtgcctcctattttggtcttttgaggaatcagcagtttagttctagttccaaatttcccaaactggatatcttatttgggtcaaatcttacggcatttgagtgccaacaaatcactccaactgcctcttcagtagctggaaataaatcctaaacagaacatctaaggtacggggaaacaaaccgttcaggagttcccactgtggctcagtggtaatgaatccaactagtatccatgaggttgcaggttcaatccctggcctcactctgtgggttaaggatctggcgttgctgtaagctgaagtgtaggtcacacaagcagctcagatctggtgttgctgtgactgtggtgtaggccagcaactgcagctctgatttgacccctagcctgggaactttcatatgccatgggtgcagccctaaaaagcaaaacaaaaaaccaaacatccagcatactgaaggatagcctctgttaggttacatcctgcagaactggaagatttttgactatcaccccctgacccccatacatttaatctttgtatgtaatacgccctgatcccaataccggctgggagatgggaaaagttggcccatcaatgagtctctaaattacaccattttacaatttgacctgttaggctagagacaagaaatgatatcaaattccccatgtccagtttttatggccttagaaaaaatgaccttcaaaagagatgtgggctctcctccactgaggtaataccagtccctaatcccctcctcgatcccctcccaaacccttctcctactactccctccctactctcttccttcatatgtccagatttgggacacaggcccaagaagcccccttcatgccagctccctccctcagaacccagtccagcaactgcatgaagtgggactaattaccagccaggatccaacaacttgccatgaaaagtcttccctttgaggcagaaggaaggctcatccagatatatagcccatttaccacttccaatctgtttaactggaaaagttatagcaaggggctgaagaaagatccagagggcttcctagatctgattaggagaatccttcagatccatgaccccacctgggctcacatccacagtctcctcaacatactcctaatgggggaagaaaaggccatggtcttttcaaaagctggagaggaaacagacaaagagaacagaaacattgcaggtcatgctattttcagatggaggaatcaagtggtcccagataatgaacccaactgggaccaccaagaccatggagaaggaggtggaagacagaggctgacccattataaatatatgatcctaaggggaatccaggtagcaggacagaaacctgccaactgaaataaggtaaagaaaatcaatcaggagcccaaagaagatactccagcattcctagagcctcagggaatgcctccaatctacactaccacttaccctgagtcattggaagggaatgaaatcctgaggtcatagttcatttttccaaaagtgcccccaacattaggtgtaaacttccaaaattggaaatagaacaagatactcatacctctcacctggttgagagtgcctactgggtatttaataaccaagatatagaggaggaaaagtaagggaataaagaggcccagaagaaagcccacctactggctgttgctcttcaatgtcaatcgatcagcatgggaatctggattcacctcccacagagactctcaactccagtgtgtgaccccccaaccccaggctccaacaaggtagcaagtcaggaaagtaggacccaatcagtgtgccacatgtaaacaagagtaacattggaagagagaatgctctctaagtgccctaagcaggggatggaaatggcagatcctggccactaccctcagaggcaaatgacccaaatagatgaagaatgatggggtcagggtgctcctaagctggcacaccaattgacccctgaggagccctggttgacattggatataggtggaaaacctgtcaaattcttagacaacaccagtgccacttatttctggataccaggtcaggcaaacttggtcacagggttataaaattatgggaatatcatgaaaggaccaagaatggatgaactggataaacccacccttatccattccttcctgtatgcctctgaatgacctatacccctgctgggaaaagatatcttacattaactgggggctactatccacctaacgggagacaaactggagactggcatccccttagacgaagggcacaaggtgatgataatgttaacagctgaagacaaaccttcctggactgggcaagtctgcctccctggagtatatccttaggtctgggctcagagatgggtgggacaaggtgtaagatgcggtccatttaaaacctgtacatacatggccatgagaaaatagtatcttctccaccaggaggccttgttgggcactgcccttgtgataaaggacctaatttaccagtgccttattagaccatgacaatcagactatattaacaccattctccttgtgaagaaatccagcaggaaatattggatagtacaggacctcagggtagtcattgaggccacagaggatatatacacagtagtccataatacttacacctgctttattctcatctggccactctaccattcaccaggacctggtattccattttgggttttttcacctgtgggtttttttttttttttttttttttttttttgccacactcaaggaatgcagaagttcccaggctagggatggaacccatgccacagcggtaacgcgagccacagtgacaatgctggatacttaaccactaggccaccatgaaactctaggacctggtattctgtattagatttaaaacacaccttctctattccattagccctagagtcaccagaagctttttgcttttgagtggtaggatccaaacatgcatcagaaacaacaatactgctagacagtactgattcaagggttcaaaaattctcctaccatctctggggatactttagctaaagacttaaaagatctacattttgaggaggaaatcctccagcacatagatgtcattctgatcaccagccctactaaggaggtctctaacaaaagtaactactctgaaccacttagctgataaaggatgtaagatgtcccagaaaaagtctcaaatatcataaactagggtgacctacctaggctttattctctctgaaggtcaaagaagcctaccctaggaaatgaaagaagtcatttgcagcctcacttcctcctaaaactagaagacagattaggggcttcctgtggatttctgggttttgctgcatctgtatccctaattatgatctaatagctaggcctctatatgagaagttgaaagggaaggatgatgacccttttgagttgaattcagaatgcgatgggcctttcaagaattgagaaagcagggagttcctcttgtggctcagctgtaatgaatctgactattacccatgaggacaagtttcaatccctggcctcactcagtgggttaaggatccagcattgccgtgagctgtggtaaggccacagatgtggcttggatcccggttgttgtggctgtggtatatgctggcagctgcagctccgatttcaccccttgcctgggaaaaaaaaagatttgagaaagcaattacttcaggcccctgctctgacctttccaaatttagctaaaccctctgtcctttacactgatgaaagaaggggaatcacccttggagtattagcacaaaaaccaagaccccttacttgggtggtagcttatttctctaaacaattagatcaaactgctaagggatggactccttgtctgcaggcagtggcagccactataaccctgctaaaggaggttgaaaagttaacatttggtcagccaactgtatagatcctacatctggttcaggttttactaagttctcagggaacagaattactctccccttgaagactgagtcaagttcaagctatgcttttagacaacccagtggctaccatggaaacctgtcacatattaaatcctgccaccctactacccacagaaatggggcccctgtagcatgattgtatagaaaccatagacaattttatttcagtcatccccacctaggaggtgaggctctcccaaatgcagaagaagaatggttcacaggtgggagcagttttaagagagagagagaaaggatggtaggacatgcggtgacttcccagacccaagtcatagaggcacaaagcctacccacagggacttctgctataaagctgatagcccccacctgagccttagagcttgggcagggtagatcttaaaagtttacacagattcctgctatgtgtatgccatgctacatgcacacagtgctatttggaatgaaagaggtatgtttactgcagaatataaacaggtgaaacacagcttaatcatattcaaattcttaggagcattacagcttccaaaaaatgtggcggtagttagttgtagtggttaccaaaagggggatgcagaggtaataaagggaaacaacaaggtagatgcaactgctaaaagtgtcctataaccaataacatgacaactacctctcatacccaagaggccagatccatgtaattactctccagtctatacaaaagaagaattagacaaaagtccaaaaacagagatctaggaggccatgggtggctggctaatgaacacgggcatacttctatccccaaagggaggttcatcaaggaacacattatgggagggaagccctatatagttagttgaggtcatggcaactcctggcatgaaactataatcagttgcatagctaaagcatgccccacctgtacaatgaacaacccaaacaccagaccccacctcaagagacctccatataaggcccattcagaacagaaggacataacctggagatgattggcagttggacttcattgtcatgtcaggaataccagacaatttcaggtatttcttggtgctaatggacacattttctgggtggatagaactgaagcagtagctgaagtagctaaagcattactaaaagaaataattcccaggttgaggctcccaggatgcttacaaagcaataatggtcttgtacttgtgtctcaagtgatgaaaggaataatgagtgccttgggcatacaatgggctttgcactaggtttgggacctcaatcatcagggaaagtagagaggtccaatcagaacttgaaatgagccttagccaagttatgtcatgaaactcaagagaattggattaagttgcttccaactgctctgctccatatgtggttagtcccaagggataaattaaagttacttgccttcatgtatggtagactcattcctcccgtctgagagaagagacaacttcacccccttgaaatggaaatgtgccctccaggtaagaaagctctcactgaatatgatgaccagctactgcccacacccaccaaactgggcctccaccccctctggccaggagactggctgaacataagatcctggaaaactgaaaagaccagctcattcctaagtggaacaggccccacttggtgattctaatcacccattttgccctgaagttgcagggatcattccataggcacattgcacttgaggaaagaggccccccaaaccgcaaactctggagagacaacctggggcaacagaccattttgaatactcacatgaaactctctctgacctggagcttctcttccaaaaagcaaccaaattttgaccagggagattcaggccccagcggtgagacttgacatcagggcacacttgtgcctacagtcagggctgaagccgggtgaccatcaaacacatctaaagacagttggggcgaagctctgctcctcccctgggtgttaggacaatggccaaaatcagcaggaagtagttacagaagatgggacctgtacccctcaagaatgaggagtggaacaaaggacagaggagaggtttgttaccagcaaagcctgttaacaatttccgggaaataaaaatagaatctgggtaataaagtctaaccttttttactttttcccttgtgcttcatctagtttcatgtgctcatagtgggctgtatacagaggcctcaaacctagcacttcagactggagttcccagtgcaaagtggctgtaccaaca

SEQ ID NO: 215 - DNA, 8239 bp, artificial
  ss1968 sequence
tggatcttgttttccaccctcctcctgttgaaatgaaatggagttttaactgaaggacagcccccccccccctggctaagaaggcagctgcaagcctttccagctgtgctcatcactataccacccttcctctaataatgtaacaactgtgtgccctatgtccaagccagaagccctgctaatcaggtacccaacattgcgtatcagttccgcttctgtaaccttgcccgctcagtttcttagggaggaacactgtctgcttggggatggggggaggtccgggatgcttacatgggaaaatcaagaccttgtagtgtataatagttactgagaacaaagacctggtgctcagactctggaggtgactcctgagcccacaccggtgctgaataaaacttgcttttccatatctccgagtgctgtttgtctccttccgttgccacagtttctgcggtttccgcaacatttttggtgcgttggccgggaagctgacaaccgagctggcttcttgtgccaccattgtcggggaaccgggggaggccacggtcgccggccctgtgacaggtggatagcccgcaccggccattttgccggatccagaccctcactcgggccatggccttggcccacaccgcttcccaaacggactcagaaggagagtggaaacaggttcctggacaggacgtcagactggtgagtgcccaggggacatctgcccaagtcaggacccgccatatggcggaaggagagactgatcacctctcagtgaccaaagagtcactcaggtcagggtttgctcccttgagatcaggaggcttgtcaattctggtgtgtgtgtgtgtgagtgactggagagaacgagagcccatgctccaccgtctttggactacggagccagagtgagtcctaacctgcagttccgcggcgaccctcatacggcttatggtggccctcttcggggggatcctgacgttggggtttatacagtcccacccatgctaagaggcgcctaaaatatctcctccgggggagcggtcaggcggaagaagcgattgttacttgaggccttgccctcactgtttgtcttgcgtcaccggcacagggtgggacttcacacaatgggtaaatcggcttccaagcccactgtcttagagtgtatggttaagaattttaaaaaaggattttctagagattatggtgttaagctgagtcctggaaaactatgtaccctctgtaccatagagtggccctcctttggtgttggctggcctctggaagggaccttagatgtgttcacagttacagcagtatataatgttataacaggagaccctggacacccagaccaatttccgtatattgatcaatggttggaaattgcctatttgaggcccccatgggtttggttctgcaccacagaccagggacagtataaggtgctagtagcccagtccaagaagaaaaccttgtctcaaaagaaggtgccacctatttatcaaggggaacctgaggactcaccccctatgccaccaccttatgtgctgccagccccaactccaggagccgaaggtccccagatgccagatagcccactgccttctgtttctcctcctccttctgcttctgaagttcccgaggcgatatcacccccgcagccagattctccagaacctatgagcaggcatctctgttcagttcagggagcagccaccccaggattacaaatgcccttacgggagacacggggaccacagcaagttgcctccgatgggaccatacaagaggggggacgtttttattattaccagcccttttccactgccaatctcctcaactggaaacaccatactccctcatattctgaaaagcctcaggtgctgattgatctcttagaattcattttccagacacactgtcccacctggatagactgccagcaactcctttttactctatttgaaactgaagcgcgctggcgaattgtaacagaagcccaaaaatggcttcaggccaatgcggggggtccagcagacttggcaaactgggtgagggaagccttcccagaagaaaacccccactgggattatgacactgaagaagggaaacgtaacctagagaggtaccggcaggccttcctacagggggcaaaagctggggctaaaaggcccactaatatagctaagatcagtgagatactacaagagccgaatgaaagcccagtcaaattctatgagagactatgtgaggctttctgaatctacaccccttttgatcccaaggcccctgaaaaccaacggatgataaatgctgcctttgtgggacaagcccaatcaaatatctgtaaaaagctacagaaattagaaggatttgaaggataaaatgccactaaactattggaaatagccaacaaggtttttgttaaccgagaccaggtggcccgccgtgatgcagaaaagagaatgaaacaaaaagtgactcttctggcagccgccctgtcaaaaccggtgcccccagtgggaccaccccgtaggggacaaggcacaaggccaggaagaaggagtcccctggtacatgaccaatgtgcttactgcaaagaaaagggacattggaaaaatgaatgccccaaccgtcctgagaaaaagaccaaggccccacctagctggtaccgatctgagccattcagcaccaacctgattggcctagctgagtctgattaggggggaccaggctctctccaactgggcccccaagagtctatggtcagaattcaagtagggggccaccccatagactttatggttgacacaggtgccgaactttctgtggtcacacaacctgtggctcccctctcggggaaagaaaccaccattgttgcggccacaggtaaccaaacccacaggcccttctgtggtcctcgacgatgtcggttaggaggccatgaagtaatacatgaatttctttacctgcctgactgcccagtccccctaatgggaagagacctgctggctaaaatggggacacaaatttccttttctactgatggatcagcccaacttaaattgacagaacccccctctcctttaatcatggctcttgctgtaaaaagggaagaggaatggcgcttgtactcttccccttcagaaatggggaccattcccccagaactagagactaaatacccattggtttgggctgaaggaaacccaccaggactggcaaaatgccatgctcctgtcttgattgatctaaaacctggagctcaaccagtaaagctacgacaatactcaattcccagagaagctcgactgggaatccaggttcacctggataggctgcttcagcatggactgttaataaaatgtcagtccccttggaacacccctttactgcccgtgaaaaaaccaggaacacaggactaccgcccagtacaggacttgagagccataaatgaagcaacagtcacattacacccatccgtccctaacccatataccctgctagggctgatcccctccactgctaagtggtttacttgcctggacttaaaagacacttttttctgcctctgggtggcacctgccagtcagcccttgtttgcttttgaatgggagaatccacatacagggacaaaggaacagctcacctggactagactcccacaaggattcaaaaactctcccactctttttagcggcgccttagctgctgacctggctgaatttcctggacaaaaactaggctgtgttttttagtacagtatgttgatgacctcttactagctggcaccacggaggttcagtgcctagagggaacaagagctctcctttccctactgatggaggcagactatcgagtatcaaaaaaaaaaaaggcacaaatctgcaaaaaaaaaaaaagtatctgggcttcgactttatgcggggccgacaaatgctggggactgaaagcaggcagtttgtgccattcctgtccctaccacccgccggaaggttcgtgagttcttagggacagcaggattctgccggatatggatccccgggttttcagacctggccaggcctctgtatgaggctctaaaaggggaagaaaaggctccccttgaatggggaccaagccagagacagcatttcagacaatcaaaaccaaactcactgaggctccagtcttgggacttcctgatgtaaccagagaatttaaccttttagttcatgagaaaaatgggatggctttgggagtcttaactcaagaatttaggccttggcagaggctagtggcatatctgtctaaacaaattgactcagttgctgccggatggcctccctgcctccgagcgctggcagctaccaccttgttggtaagagaggctgacaagttgaccctgggacaaaacctcaatgttaaagtcccacactcagttgtaaccctaatggataccaggggccaccattggctcacacatgcacgaatgattcaatatcaagggttactatgtgaaaatccacgggtaaaactggaggttgtacgaactctgaacccagccacttttctgccagatgaagcggggcccccagaccataattgcctggaggtactagatgaggtgttttccagcaggcctgacttgactgatcaaccactccaaaatcctgacctggttttatatactgatggcagcagctttatggaggatgggaaaaggatggcaggatatgctgtggtatctgacttaaaagtgatagaagcagaggtgctttctcaaggctggtcagcacagagagcagaattatgggccttaatcagagcactggaattcagctgagaccagtgagttaatatctataccgattcacgataggcctttgcaactttacatgtccatggagccttatataaagaaagagggctcctcactgctgaaggaaaaggaattaaaaaccaggctgaaatcttaaagctcctagaggcagtatgggaacctaaagaagttgcagttatccactgtaaaggccaccaaaagggggatgacccagtgacaaaaggaaaccgtagtgttgatacagctgccagacaggcagcccggggacaacagccagacaaacctaaggtcttgctggccccagaagtgccagctgtccccagatattctccagaggaagaaaaatggataagggaggaaggggaaactaaaactaaaacggggtggtgggtcacatgggaccaccgagtttacattccagaacagctggcctacaaactagtccgccaagaacatgagctaacccacatgggcaaaactgccttagagaccctactgggccggtactatctcattgcttctcttcctgcactctgctcctctgtctcccaaagatgcataacctgtttacagaataatgcccgccaggggccccacagaccagctggggcacagcactgcggactgtccccatttgaggatatggaagtggactttactgaggtcacccctagtaaggggtacaaatatttactagtttttatctgtactttttcaggatgggtaaaaaccttccctacccaaactgaaaaggcaagggaagtaaccaaggcactcctgagagacattattcccagatatgggatgcctctgaccattgggtcagataatggactggcagttgtggctgaaacagtacaacaggtggcaaaagctttacagatccgatggaaactacattctgcttatcaccctcaaagttcagggaaagtagaacacatcaaccgaacccttaaacagacactggcaaagttatgtcaggaaactggcttgccctggatagacatgttgccggtggccctcttaaaagtgagatgctcaccccgagcgggaataggattctcgccatttgaaatcttatatggaaggccacctccactaatcagtttaaaaggaagcaccagggagttgggagacttggaactacataaacaattacaaggactggggctcactatttttcggatacataaatggatcacagacagaacacctgtgtccttaggtataacagtacacccccacaagccgggggaccaggtgtggataaaggactggaaaaaggagcctttgaggccggtatggaagggcccctatactgtaattctaaccacccccactgctcttaaagtaacaggaatagatgcttggacccatcattctagagttaaaccggctggcccagctgacgaccgtggagagtgggagactgcccttaatccggagagacctcttcgcctgacaatacagagaaggagacgaagatctcaaagccctgctctgactgcaccggaagctggtcagtcaacgcacggctgaagcttgagaaattggctgcctgtgagcccaaatggaaggagggtttcaaaataaacattcacattgacggaaaaggccttgaccctggagctgtgctacatttccagagaatcacgtttgtgctccaaggtgcctctcacagggtctttcattccttttataaagagataaaaaacaccccacctcccattccggccacaactaagaacttgttcttagccctggcagaaactattgcacaaattctcaaggtctcctcttgttatgtatacgggggaacaaacacaggagaccactggccttggcaagccagagaactggacccattagaacctcataatgagactacatacccccaactcaccgatggggtgtggctcctcagaactgctattattgggagaaattgtcttgcgaggcggggaggacggtttaatgtttcagttggaagcctaacatgtttaggcctaaggtattataatctgactgcccaaaagactcaatggtggtcatcctccaatctctcagagcccaaacctaatcccttgtctaacttttccctcctttgacaagcatggaaagatatcactactaatatccagtggtgggcaccaaagggattatattggatttgtgaaaaaatggcctattccatactccccccaaattgggctgggacatgtgtactgggaacaatcagaccctccttcttcctgctcccactgtcactaggggaacaactgggaattcctatatatagggcacagggtgcccagagagaccggagggctctccaaattggagactggaaagatgatgaatggcccccagaacggataattcaatattatgggcctgccacctgggcagaggatggcttttggggatatcacacccctgtctatatgctgaaccacatcatcagactacaggcggttttggaacttataacaaatgacactgcaagggccttgactatattggcccaacaataaactaaaatacacagtgaaatctacaaaaattgcttggccttggattatctacttgcttctaaaggaggggtttgtggaaaatttaacttacgtaattgctatctacaaatagatgacaccggaaaggtggtagaagaaattgctgacctcatgactaaacttgcccatgtgcctgcacatccttggaaaggacgggatgcagacagtctctttggtaaatggttttcttggttgggaaaaattaagacaatggtcggaataatcatggttatactcacagggtgcctacttattccctgccttgtacctctcctgataagtattataaaaggttttataaaaaccatgctttaaaaaaaaaaaaaaaaaacagcctctactaattaggggtaccaaagggttctgaccgatgatgatctgtaaagggtgcagatgcaccctgaacatcaagaggcggggaatgaaatggagttttaactaaaggacaaccccccccttggctaagaaggcagctgaaagcctttccagctgtgctcatcactataccacccttcctctaataatgtaacaactgtgtgtcctatgtccaagccagaagccctgctaatcaggtacccaacattgcgtatcagttctgcttctgtaaccttgcctgctcagtttcttagggaggaacactgtctgcttggggatggggggaggtccgggatgcttacatgggaaaatcaagaccttgtagtgtataatagttactgagaacaaagacctggtgctcagactctggaggtgactcctctgagcccacactggtgctgaataaaacttgcttttccatatctccgagtgctgtttgtctccttccgttgccacggtttttgcggtttccgca

SEQ ID NO: 216 - DNA, 8239 bp, artificial
  ss1969 sequence
tggatcttgttttccaccctcctcctgttgaaatgaaatggagttttaactgaaggacagcccccccccccctggctaagaaggcagctgcaagcctttccagctgtgctcatcactataccacccttcctctaataatgtaacaactgtgtgccctatgtccaagccagaagccctgctaatcaggtacccaacattgcgtatcagttccgcttctgtaaccttgcccgctcagtttcttagggaggaacactgtctgcttggggatggggggaggtccgggatgcttacatgggaaaatcaagaccttgtagtgtataatagttactgagaacaaagacctggtgctcagactctggaggtgactcctgagcccacaccggtgctgaataaaacttgcttttccatatctccgagtgctgtttgtctccttccgttgccacagtttctgcggtttccgcaacatttttggtgcgttggccgggaagctgacaaccgagctggcttcttgtgccaccattgtcggggaaccgggggaggccacggtcgccggccctgtgacaggtggatagcccgcaccggccattttgccggatccagaccctcactcgggccatggccttggcccacaccgcttcccaaacggactcagaaggagagtggaaacaggttcctggacaggacgtcagactggtgagtgcccaggggacatctgcccaagtcaggacccgccatatggcggaaggagagactgatcacctctcagtgaccaaagagtcactcaggtcagggtttgctcccttgagatcaggaggcttgtcaattctggtgtgtgtgtgtgtgagtgactggagagaacgagagcccatgctccaccgtctttggactacggagccagagtgagtcctaacctgcagttccgcggcgaccctcatacggcttatggtggccctcttcggggggatcctgacgttggggtttatacagtcccacccatgctaagaggcgcctaaaatatctcctccgggggagcggtcaggcggaagaagcgattgttacttgaggccttgccctcactgtttgtcttgcgtcaccggcacagggtgggacttcacacaatgggtaaatcggcttccaagcccactgtcttagagtgtatggttaagaattttaaaaaaggattttctagagattatggtgttaagctgagtcctggaaaactatgtaccctctgtaccatagagtggccctcctttggtgttggctggcctctggaagggaccttagatgtgttcacagttacagcagtatataatgttataacaggagaccctggacacccagaccaatttccgtatattgatcaatggttggaaattgcctatttgaggcccccatgggtttggttctgcaccacagaccagggacagtataaggtgctagtagcccagtccaagaagaaaaccttgtctcaaaagaaggtgccacctatttatcaaggggaacctgaggactcaccccctatgccaccaccttatgtgctgccagccccaactccaggagccgaaggtccccagatgccagatagcccactgccttctgtttctcctcctccttctgcttctgaagttcccgaggcgatatcacccccgcagccagattctccagaacctatgagcaggcatctctgttcagttcagggagcagccaccccaggattacaaatgcccttacgggagacacggggaccacagcaagttgcctccgatgggaccatacaagaggggggacgtttttattattaccagcccttttccactgccaatctcctcaactggaaacaccatactccctcatattctgaaaagcctcaggtgctgattgatctcttagaattcattttccagacacactgtcccacctggatagactgccagcaactcctttttactctatttgaaactgaagcgcgctggcgaattgtaacagaagcccaaaaatggcttcaggccaatgcggggggtccagcagacttggcaaactgggtgagggaagccttcccagaagaaaacccccactgggattatgacactgaagaagggaaacgtaacctagagaggtaccggcaggccttcctacagggggcaaaagctggggctaaaaggcccactaatatagctaagatcagtgagatactacaagagccgaatgaaagcccagtcaaattctatgagagactatgtgaggctttctgaatctacaccccttttgatcccaaggcccctgaaaaccaacggatgataaatgctgcctttgtgggacaagcccaatcaaatatctgtaaaaagctacagaaattagaaggatttgaaggataaaatgccactaaactattggaaatagccaacaaggtttttgttaaccgagaccaggtggcccgccgtgatgcagaaaagagaatgaaacaaaaagtgactcttctggcagccgccctgtcaaaaccggtgcccccagtgggaccaccccgtaggggacaaggcacaaggccaggaagaaggagtcccctggtacatgaccaatgtgcttactgcaaagaaaagggacattggaaaaatgaatgccccaaccgtcctgagaaaaagaccaaggccccacctagctggtaccgatctgagccattcagcaccaacctgattggcctagctgagtctgattaggggggaccaggctctctccaactgggcccccaagagtctatggtcagaattcaagtagggggccaccccatagactttatggttgacacaggtgccgaactttctgtggtcacacaacctgtggctcccctctcggggaaagaaaccaccattgttgcggccacaggtaaccaaacccacaggcccttctgtggtcctcgacgatgtcggttaggaggccatgaagtaatacatgaatttctttacctgcctgactgcccagtccccctaatgggaagagacctgctggctaaaatggggacacaaatttccttttctactgatggatcagcccaacttaaattgacagaacccccctctcctttaatcatggctcttgctgtaaaaagggaagaggaatggcgcttgtactcttccccttcagaaatggggaccattcccccagaactagagactaaatacccattggtttgggctgaaggaaacccaccaggactggcaaaatgccatgctcctgtcttgattgatctaaaacctggagctcaaccagtaaagctacgacaatactcaattcccagagaagctcgactgggaatccaggttcacctggataggctgcttcagcatggactgttaataaaatgtcagtccccttggaacacccctttactgcccgtgaaaaaaccaggaacacaggactaccgcccagtacaggacttgagagccataaatgaagcaacagtcacattacacccgtccgtccctaacccatataccctgctagggctgatcccctccactgctaagtggtttacttgcctggacttaaaagacacttttttctgcctctgggtggcacctgccagtcagcccttgtttgcttttgaatgggagaatccacatacagggacaaaggaacagctcacctggactagactcccacaaggattcaaaaactctcccactctttttagcggcgccttagctgctgacctggctgaatttcctggacaaaaactaggctgtgttttttagtacagtatgttgatgacctcttactagctggcaccacggaggttcagtgcctagagggaacaagagctctcctttccctactgatggaggcagactatcgagtatcaaaaaaaaaaaaggcacaaatctgcaaaaaaaaaaaaagtatctgggcttcgactttatgcggggccgacaaatgctggggactgaaagcaggcagtttgtgccattcctgtccctaccacccgccggaaggttcgtgagttcttagggacagcaggattctgccggatatggatccccgggttttcagacctggccaggcctctgtatgaggctctaaaaggggaagaaaaggctccccttgaatggggaccaagccagagacagcatttcagacaatcaaaaccaaactcactgaggctccagtcttgggacttcctgatgtaaccagagaatttaaccttttagttcatgagaaaaatgggatggctttgggagtcttaactcaagaatttaggccttggcagaggctagtggcatatctgtctaaacaaattgactcagttgctgccggatggcctccctgcctccgagcgctggcagctaccaccttgttggtaagagaggctgacaagttgaccctgggacaaaacctcaatgttaaagtcccacactcagttgtaaccctaatggataccaggggccaccattggctcacacatgcacgaatgattcaatatcaagggttactatgtgaaaatccacgggtaaaactggaggttgtacgaactctgaacccagccacttttctgccagatgaagcggggcccccagaccataattgcctggaggtactagatgaggtgttttccagcaggcctgacttgactgatcaaccactccaaaatcctgacctggttttatatactgatggcagcagctttatggaggatgggaaaaggatggcaggatatgctgtggtatctgacttaaaagtgatagaagcagaggtgctttctcaaggctggtcagcacagagagcagaattatgggccttaatcagagcactggaattcagctgagaccagtgagttaatatctataccgattcacgataggcctttgcaactttacatgtccatggagccttatataaagaaagagggctcctcactgctgaaggaaaaggaattaaaaaccaggctgaaatcttaaagctcctagaggcagtatgggaacctaaagaagttgcagttatccactgtaaaggccaccaaaagggggatgacccagtgacaaaaggaaaccgtagtgttgatacagctgccagacaggcagcccggggacaacagccagacaaacctaaggtcttgctggccccagaagtgccagctgtccccagatattctccagaggaagaaaaatggataagggaggaaggggaaactaaaactaaaacggggtggtgggtcacatgggaccaccgagtttacattccagaacagctggcctacaaactagtccgccaagaacatgagctaacccacatgggcaaaactgccttagagaccctactgggccggtactatctcattgcttctcttcctgcactctgctcctctgtctcccaaagatgcataacctgtttacagaataatgcccgccaggggccccacagaccagctggggcacagcactgcggactgtccccatttgaggatatggaagtggactttactgaggtcacccctagtaaggggtacaaatatttactagtttttatctgtactttttcaggatgggtaaaaaccttccctacccaaactgaaaaggcaagggaagtaaccaaggcactcctgagagacattattcccagatatgggatgcctctgaccattgggtcagataatggactggcagttgtggctgaaacagtacaacaggtggcaaaagctttacagatccgatggaaactacattctgcttatcaccctcaaagttcagggaaagtagaacacatcaaccgaacccttaaacagacactggcaaagttatgtcaggaaactggcttgccctggatagacatgttgccggtggccctcttaaaagtgagatgctcaccccgagcgggaataggattctcgccatttgaaatcttatatggaaggccacctccactaatcagtttaaaaggaagcaccagggagttgggagacttggaactacataaacaattacaaggactggggctcactatttttcggatacataaatggatcacagacagaacacctgtgtccttaggtataacagtacacccccacaagccgggggaccaggtgtggataaaggactggaaaaaggagcctttgaggccggtatggaagggcccctatactgtaattctaaccacccccactgctcttaaagtaacaggaatagatgcttggacccatcattctagagttaaaccggctggcccagctgacgaccgtggagagtgggagactgcccttaatccggagagacctcttcgcctgacaatacagagaaggagacgaagatctcaaagccctgctctgactgcaccggaagctggtcagtcaacgcatggctgaagcttgagaaattggctgcctgtgagcccaaatggaaggagggtttcaaaataaacattcacattgacggaaaaggccttgaccctggagctgtgctacatttccagagaatcacgtttgtgctccaaggtgcctctcacagggtctttcattccttttataaagagataaaaaacaccccacctcccattccggccacaactaagaacttgttcttagccctggcagaaactattgcacaaattctcaaggtctcctcttgttatgtatacgggggaacaaacacaggagaccactggccttggcaagccagagaactggacccattagaacctcataatgagactacatacccccaactcaccgatggggtgtggctcctcagaactgctattattgggagaaattgtcttgcgaggcggggaggacggtttaatgtttcagttggaagcctaacatgtttaggcctaaggtattataatctgactgcccaaaagactcaatggtggtcatcctccaatctctcagagcccaaacctaatcccttgtctaacttttccctcctttgacaagcatggaaagatatcactactaatatccagtggtgggcaccaaagggattatattggatttgtgaaaaaatggcctattccatactccccccaaattgggctgggacatgtgtactgggaacaatcagaccctccttcttcctgctcccactgtcactaggggaacaactgggaattcctatatatagggcacagggtgcccagagagaccggagggctctccaaattggagactggaaagatgatgaatggcccccagaacggataattcaatattatgggcctgccacctgggcagaggatggcttttggggatatcacacccctgtctatatgctgaaccacatcatcagactacaggcggttttggaacttataacaaatgacactgcaagggccttgactatattggcccaacaataaactaaaatacacagtgaaatctacaaaaattgcttggccttggattatctacttgcttctaaaggaggggtttgtggaaaatttaacttacgtaattgctatctacaaatagatgacaccggaaaggtggtagaagaaattgctgacctcatgactaaacttgcccatgtgcctgcacatccttggaaaggacgggatgcagacagtctctttggtaaatggttttcttggttgggaaaaattaagacaatggtcggaataatcatggttatactcacagggtgcctacttattccctgccttgtacctctcctgataagtattataaaaggttttataaaaaccatgctttaaaaaaaaaaaaaaaaaacagcctctactaattaggggtaccaaagggttctgaccgatgatgatctgtaaagggtgcagatgcaccctgaacatcaagaggcggggaatgaaatggagttttaactaaaggacaaccccccccttggctaagaaggcagctgaaagcctttccagctgtgctcatcactataccacccttcctctaataatgtaacaactgtgtgtcctatgtccaagccagaagccctgctaatcaggtacccaacattgcgtatcagttctgcttctgtaaccttgcctgctcagtttcttagggaggaacactgtctgcttggggatggggggaggtccgggatgcttacatgggaaaatcaagaccttgtagtgtataatagttactgagaacaaagacctggtgctcagactctggaggtgactcctctgagcccacactggtgctgaataaaacttgcttttccatatctccgagtgctgtttgtctccttccgttgccacggtttttgcggtttccgca

SEQ ID NO: 217 - DNA, 8626 bp, artificial
  ss1975 sequence
tgtctgcttggggatgggggaggtccgggatgcttacatgggaaaatcaagaccttgtagtgtataaaagttactgagaacaaagacctggtgctcagactctggaggtgactcctctgagcccgcaccggtgctgaataaaccttgcttttccatatctccgagtgctgtttgtctctttccattgccacagtttttgcggtttccgcaacatttttggtgcgttggccgggaagccgacaaccaagctggcctcttgtgccaccattgttggggaaccgggggaggccacggttgccggcccggtgacaggtggatagcgcgcactggccattttgccggatccagaccctcactcgggccgtgctggccttggcccacaccgcttcccgaacggactcagaaggagagtggaaacaggttcctggacaggacgtcggactggtgagtgccctgcggatatctgcccaagtcaggacctggaaggagagactgatcacctctcagtgaccaaagagtcactcaggtcagggcttgctcccttgagatcgggaggcttgtcaattctggtgtgtgtgtgtgtgtgtgtgtgtgtgtgtgtgtgtgtgtgtgtgtgtgtgtgtgtgtgtgactggagagaatgagagcctgtgctccaccatccttggacttcggagccagagtgagtcctaacctgcagttccgtggcaacctcatacggcttatggtggccctctttggggggatcctgacgttggggtttatacagtcccacctatgctaagaggcgcctgaaatatctcctccgggggtgcggtcaggcggacgaagcaattgttaccttgtcctcactgtttgtcctgcgtcaccatcacagggtgggactttacacaatgggtaaattggcttccaagcccactgtcttagagtgtatggttaagaattttaagaaaggatttctagagattatggtgttaagctgagtcctagaaaactatgtaccctctgtaccctagagtggccctcttttggtgttggctggcctccagaagggaccttagatgtgttcacagttacagcagtatataatgttataacaggagaccctggacacccagaccaatttccatatattgatcaatggttggaaattgcctatttgaggcccccatgggtttggctctgcaccacagaccagggacagtgtagggtgctagtagcccagtccaagaagaaaaccttgtctcaaaagaaggtgccacctatttatcaaggggaacctgatgactcgccccctatgccaccaccttatgtgctgccggccccacctccaggagctaaaggtccccagatgccagatagcccaccaccttctgtttctcctcctccttctgcttctgaagttcccgaggcgatatcacccccgcagccagattctccagaacctatgagcaggtgtctctggtcagctcagggagcagccactccagcattgcaaatgcccttaagggaccatacaagaggggggacgtttttattattaccagcccttttccactgccgatctcctcaactggaaacaccatactccctcatattctgaaaagcctcaggcgctgactgatctcttagaattcattttccagacacaccgtcccacctggatagactgccggcaactcctttttactctatttgaaactgaagcgcgctggcaaattataacagaagccccaaaatggcttcaggccaatgcggggggtccagcagacttggcaaactgggtgagggaagccttcctagaagaacacccccactgggactatgacactgaggaagggaaacataacctagagaggtaccggcaggccttcctacagggggcaaaagctggggctaaaaggcccactaatatagctaagatcagtgagatactacaagagccgaatgaaagcccagccaaattctatgagagactatgtgaggctttccgaacctacaccccttttgatcccgaggcccctgaaaaccaacagatgataaatgctgcctttgtgggacaagcccaatcagatacccgtaaaaagctacagaaattaaaaggctttgcaggagagaatgccactaaactgttggaaatagcccacaaggtttttattaaccgagaccaggtggcccgccgtgatgcagaaaagagaatgaaacaaagtgactcttctggcagccgccctgtcaaaaccggtgcccccagtgggaccaccccgtaggggacaaggcacaaggccagggaaaaggagtcccctggaacatgaccaatgtgcttactgcaaagaaaagggacattggaaaaatgaatgccccaaccgtcctgagaaaaagaccaaggccccacctagctggtactgatctgagccattcagcaccaacctgatcggcctagctgagtctgattaggggggaccaggctctctccaactgggcccccgagagcctatggtcagaactcaagtagggggccaccccatagactttatggttgacacaggtgctgaactttctgtggttacacaacctgtggctcccctcttggggaaagaaaccaccattgttggggccacaggtaaccaaacccacaggcccttctgcggtccttgacgatgtcagttagaaggccatgaagtaatacatgaatttctttacctgcctgactgcccagtccccctgatgggaagagacctgctggctaaaatgggggcacaaatttccttttctactgatggatcagcccaacttaaattgacagaacccccctctcctttaatcatggctcttgctgtaaaaagggaagaggaatggcgcttgtactcttccccttcagaaatggggaccattcccccagaactagagactaaatacccattggtttgggctgaaggaaacccaccaggactggcaaaacgccatgctcctgtcttaattgatctaaaacccggagctcaaccggtaaagctacggcaacactcaattcccagagaagctcgactgggaatccaggttcacctggataggctgcttcagcatggactgttaataaaatgtcagtccccttggaacacccctttactgcccgtgaaaaaaccaggaacacaggactaccgcccagtacaggacttgagagccataaatgaagcaacagtcacattacacccgtccgtccctaacccatataccctgctagggctgatcccctccactgctaagcggtttacttgcctggacttaaaagacacttttttctgcctctgggtggcacctgccagtcagcccttgtttgcttttgaatgggagaatccacatacagggacaaaggaacagctcacctggactagactcccacaaggattcaaaaactctcccactctttttagcggcgccttagctgctgacctggctgaatttcctggacaaaaactgggctgtgttttttagtacagtatgttgacgacctcttactagctggcaccatggaggctcagtgcctagagggaacaagagctctcctttccctactgatggaggcagggtatcgggtaccaaagaaaaaggcacaaatctgcaaaaaacaagtcaagtatctgggcttcaacatcatgcagggccgacgaatgctggggactgaaagaaagcaggcagtttgtgccattcctgtccctaccacccaccggaaggttcgtgagttcctaggggcagcaggattctgccggacatggatccccgggttttcagacctggccaggcctctgtatgaggctctaaaaggggaagaaaagctccccttaaatggggaccaagccaggagacagcgtttcagacaatcaaaaccaaactcactgaggctccagccttgggacttcctgatgtaaccagagaatttaaccttttagttcatgagaaaaatgggatggctttgggagtcttaactcaagaatttgggccttggcagaggccagtggcatatctgtctaaacaaattgactcagttgctgctggatggcctccctgcctccgagcgctggcagctaccaccttgttggtaagagaggctgacaagttgaccctgggacaaaatctcaatgttaaagtcccacactcagttgtaaccctaatggataccaggggccaccattggctcacacatgcacgaatgactcaatatcaagggttactatgtgaaaatccatgggtaaaactggaggttgtatgaactctgagcccagccacttttctgccagataaagcggggcccccagaccataactgcctggaggtactagatgaggtattttccagcaggcctgacttgactgatcaaccactccaaaatcctgacctggttttatatactgatggcagcagttttatggaggatggaaaaaggatggcaggatatgctgtggtgatagaagcagaggtgcttcctcaaggctggtcagcacagagagcagaattatgggccttaatcagagcactggaactcagccaagaccagtgagttaatatctatactgactcacgatatgcctttgcaactttacatgtccatggagccttatataaagaaagagggctcctcactgctgaaggaaaaggagttaaaaaccaggctgaaatcttaaagctcctagaggcagtatgggaacctaaagaagttgcagttatccactgtaaaggccaccaaaagggggatgacccagtgacagaaggaaactgtagtgctgatgcagctgccagacaggaagcccagggacaacagccagacaaacctaaggtcttgctggccccagaagtgccagctgtccccaaatattctccagaaaaagaaaaatggataaggaagaaaggaggaactaaaactaaaacggggtggtgggtcacatgggaccaccgagtttacattccagaacagctggcctacaaactagtccaccaagaacatgacctaacccacatgggcaaaactgccttagagaccctactgggccggtactatctcattgctcttcttcctgcactctgctcctctgtctcccaaagatgcataacctgtttacagaataatgcccaccaggggccccacagaccagctgggacacagcactgcggactgtccccatttgaggatataaaagtggactttactgaggtcacccctagtaaggggtacaaatatttactagtttttatctataatttttcagaatgggtagaggacttccctacccaaactaaaaaaacaaaaaaagtaaccaagacactcctgagagacattattcccagatatgaaatacctctgaccatcgggtcagataatggactggcatttgtggctgaaacagtacaacaggtgacaaaagctttacagatctgatggaaactacattctgtgtatcgccctcaaagttcagaaaaagtaaaacacataaaccaaacccttaaacagaccctggcaaagttatgtcaggaaactggcttgccctggatagacatgttgccggtggccctcttaaaagtgagatgctcaccccgagcgggaataggattctcaccatttgaaatcttatatggaaggccacctccattaatcagtttaaaaggaagcaccagggagttgggagacttggaattacataaacaattacaaggactggggctcactatttctcggatacatagctgggtcacagacagaatacctgtgtccttaggtataacagtacacccccacaagccgggggaccaggtgtggataaaggactggaaaaaggagcctttgaggctggtatggaagggcccctatactgtaattctaaccacccccactgctcttaaagtaacaggaatagatgcttggatccatcattctagagtaaaaccggctggcacagctgacgaccttggagagtgggagactgccctcaatccggagagacctctttgcctgacaatacagagaaggagacgacgatctcaaagccctgctctgaccgcaccggaagctggtcagtcaacgcacagctgaagcttgaggaatcagcagcctggtaaaataaactgccttacctcccttccacaagagactctctgtcatatactgttatcttatgacaacatgtatgtttgctgcctgttgctgttaatctggtcccctttggttctgtcaggatccatgtcctcatgtgacccgtgcattcgagtgacctgatcagatcaaggggttacatggactttgctttactccactcatttctcctgttccggagaaattcatggaagttgtactcacaacaggaccacttattctatctgtcaacaggggggccaatatacttgctttgatccacgatactcaccaactgaggaatggttagaagtccggcgctctcataaatcagggcagctaattaatcggacccaaattaccaaccccaagttgccagtgtcagtactttttgatgcctgtgaagctgtgaatgggtcatggacttctactagaccatgtggaagcccatcatgggaaagagaatataggctccagcataaatatatgtgctgggggaccacctggaatgattgcctggaatgcacttactggagctgcgtggcctgggcaacctggaataagggagacaaaacagctgtccttcaaaagggtacagcccctccagactgccagactaaagcttgtaacccagttaatttcactattttcaattccagtgagcccaaatggaaggagggtttcaaaataagcattcgcattgacggaagaggccttgaccctcgagctgtgttacatttccagagaatcacgtttgcactccaagctgcctctcacagcgtctttcattctttttatgaagagataagaaacaccccacctcccattctggccacaactaagaacttgttcttagccctggcagaaactctcaaggtctcctcttgttatgtatgtgggggaacaaacacaggagaccactggctttggcaagccagagaactggacccattagagcctcataatgagactgcatacccacaactcacctatggggtatggctcctcaaaactgctattattgggagaaattgtcttgtgaggtggggaggatggtttaatgtttcggtaggaagcttaacatgtttaggcctgaggtattataatctgactgcccaaaagactcaatggtggtcattctccaatcgctcagggcccaagcctaatcccttgtctaacttttcccaccttcgacaagcatgggaagatatcactactaatatccagtggcgggcaccaaagggattatattggatttgtggaaaaatggcctattccatactccccccaaattgggctggggcatgtgtactgggaacaatcagaccttctttcttcctgctcccactgtcactaggagagcaactgggagttcctatatatagggcacagggtgcccagagagaccggagggctctccaaattggagactggaaagatgatgaatggcccccagaatggataattcaatattatggacctgccacctgggcagaggatggctcttggggatatcgcacccctatctatacgctgaaccgcatcatcagactacaggcggttttggaacttataacaaatgacactgcaagggccttgactatattggcccaacaacaaactaaaatgcacagtgcaatctaccaaaatcgcttggccttggattatttacttgcttctgaaggaggggtttgtggaaaatttaacttaagtaattgctgtctacaaatagatgacaccggaaaggtggtagaagaaaatgctgaccacatgactaaactagcccatgtacctgtacaaatttggaaaggatgagatgcagacagtctctttggtaaatggttctcttggttgggaggaattaagacaatggtcggaatagtcatggttatactcacagggtgcctacttgttccctgccttgtacctctcctgataaatattatacaaggttttataagaaccatggttgaaagaaaaacagcctcccacctgctacttattagaggctaccaaagggttatgactgatgatgatctgtaaagggtgcagatgcaccctgaacatcaagaggggggaatgaaatagagttttaactaaagaacaacccccccccttggctaagaaggcagctgcaagcctttccagctgtgctcatcactataccacccttcttgtagtaatgtaacaactatgtgctctctgtccaagccagcagccctgataattaggtacctagcattgcttatcagttctgcttctgtaaccttgcttgctcagtttcttagggaggaacactgtctgcttggggatgggggaggtccgggatgcttacatgggaaaatcaagaccttgtagtgtataaaagttactgagaacaaagacctggtgctcagactctggaggtgactcctctgagcccgcaccggtgctgaataaaccttgcttttccatatctccgagtgctgtttgtctctttccattgccacagtttttgcagtttctgca

SEQ ID NO: 218 - DNA, 8786 bp, artificial
  ss1976 sequence
  misc_feature (311)..(311): n is a, c, g, or t
  misc_feature (313)..(313): n is a, c, g, or t
  misc_feature (334)..(334): n is a, c, g, or t
  misc_feature (349)..(349): n is a, c, g, or t
  misc_feature (397)..(398): n is a, c, g, or t
  misc_feature (408)..(408): n is a, c, g, or t
  misc_feature (439)..(538): n is a, c, g, or t
tgacttaagcttaagtactgttatgtgcctagaggtcagagtaagagcttaaccctttaccacctaagtggctttttaaatagtagaagaacttatatatagtaaaccctgtatgatccacccatagccactcctcacttgatctcacaataaaagcagtgtggtttcttgaggcagtgctcttggtccctgagatctggagttccctggcgtccttggtccctgagaccttgagtccgtgctcttggtccctgagaccttgagtcccccggctcccacctttacttaagataatgtcctctgtgtctggntntatgtgaactatttttccttnaagtccacagcaccnattctcagcccatcctgctgagctgccccagcaagtgcgcccacatgnngcggctcacnacagcaggccgaggatgaggacacgactacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacctttagtgtgcaagcatgttccttgaacttcatctgtccttcttactttatcctatcttcttgtcttattttatcccatcttccttctttggaaaaatagtcacagtgctggtaaacgacttaagcttaagagcaaagacctaaaggcataaatgacttaagcttaagtactgttatgtgcctagaggtcagagtaagagcttaaccctttaccacctaagtggctttttaaatagtagaagaacttatatatagtaaaccctgtatgatccacccatagccactcctcacttgatctcacaataaaagcagtgtggtttcttgaggcagtgctcttggtccctgagatctggagttccctggcgtccttggtccctgagaccttgagtccgtgctcttggtccctgagaccttgagtcccccggctcccacctttacttaagataaatgtcctctgtgtcttgttttatgttaactatttttccttaagttccacagcacccattcttcagccccatcctgctgagctggccccagcaagtggcgcccaacatggggccggctcacaaacaggcaggcacgaggaatgaaggaccacgactacagtggaaattttattcactggaagtgctgtggagccctgagaagaagggaggaattttgtgtggccacactagagaaatcctgcagataagttccctctctcagatatttacagggtaaaatgggaaactataatccttacatttatttgtttggacaactccttaaaaaggggggtgcaaaaacaagtgaaagtaagcttttgaaactttttcagactattgagagacattgtgattggctttttacatcagaaacattatatttaaagatatgggaaatggtaggaatggaacttaggatattgcaggatgagggcattcaaattcctgtgtccatttggagtacttggaacttaattaaatcagttttagaacttccagagaccacagaggacttagaggaagaaggggagtttacacctttgttggaagaatctaaatatgcagcccctgaacaaaattatcatagagaatatctggctcctgagccttcggctccaattgttgattctgatattcctcaatcgcctcctattaggagtaaggtgacgaggactcgtcaagcctctacttccagggttgtaaagaaagtgagcgctatccctgaacaccacctatcatccattcaacagggaattttacaggctcaaagggaaggtgatttggatgccatacatttagcctttccagtaactgtcagggagacagtggctccaggcactgatcccgccaaccctgatggagtttacaagttcattcatgagccctttccttttaaaattcttaaagaattaaaacaggctgttcaaaactatggtgttaattctccctttacaaaaggaatcgtgcagggagtagctgaaggaaatcgtatgattcctactgattggcatagcttaacccgtgctgtgctatcacctagtgaatatttacaatttaagtcttggtggcaagatcatgcccaaattactgctaatcgtaatcaggctcgaaatcttccaattacaatggaacaattgttagggattggtccttggagtaatcttcaagatcaattaagaatgaatgatttggctattgaacagattagacaatgttgcttaacagcatgggataaaattgaatctaagggtcaaataagtgacttcttttcaaaagatcctacaaggccctaaggaaccttatactgaatttctagctcgtttacaagaggcattaaaatgacaagttactaactctgaggtgtctgatactatttttcaattgttagcatatgaaaatgcaaacactgattgcaaaaaggccataggatttttaaaaggaaaagctaacatagccgaatatattaaagcctgtcagggagtggggacggagtcctttaaggcctcaatgctagcccaagcaatggctaatttaaaagttaaggacaaattttcaggaaaatgttttaattgtggtaagacaggacatattaaaaaacaatgtcgcgctcttccacgagcccaacctttctctcatggagcttcagcaccttttagtaacaataataaacagcccagactatgtccaagatgtaataaaggaaatcactgggctaaccagtgctggtccatctttcataaagatggaacccccttgttgggaaactatcctcggggcaagcttccagccccgtcaaccaaggaagcattccccattcagaacaagagccagactccctggaactacgctctgcaccagagttcgacatcacagtagatctccctagtttacaggatttaattctccttcctagtgaaactcctacttctattacaaccaagttggaaaatccattaccatcagatacaataggattgataataggaagggcagagctaacagaacaaggaattcgagttcataccaggatattggataataatggggatgataaagtacaagtgatggtttccactgcgattccttggaaaattaaaaaaggggatcggattgctcaaatcttaattttacctagagtccagaagaaaaaagacaggaataattttagacagaagagattcaataccacaggaggggcaggagtgtttttatcagaaaaggtcctaaaggaacgacccacttgttaagttatcataaatgggaagtcttttagaggattgattgatactggtgctgatgtttcaatcattagccatttacattggccagacacctggcctcttcagccagctgatattgaagtcactgggttaggaaaagcagagggtctcaaaaagagtgcccaatggcttaattgtgaaggaccagatgggcagccagctagattgaaaccttatgttgctcaactccctatcaatctatgggggagagatttattacaacagtggcatgcagaaatttacttaccaccagtagatcaatatagtcatcaaagccaaaaaatgttgcagaaacagggttacattcccggattgggattaggaagacatcatcaggggagagtggaacctattgactctgagattaaaatggacaaatctggtttgggatatcggccttttcattagcggccactgcttataaaaataattgtttctcctgaacctattcgactgaaatggactacagaaaaaccagtttgggttgagcagtggcctctttcttcagaaaaattaaaggttttaagtgatctggtccaagaacaattagagaagggccatatagaagaatcctttagtccctggaattcaccagtgtttgttatacagaaaaaatcaggaaaatggagattgttaacagacttaagaggagtaaatgctgtaattcagcctatgggtgcccttcaaccaggcctcccatctcctagtatgataccagctaactggttgttaattatcttggacctaaaagactgctttttcacaattcctttacacccagaagataaggaaaaatttgctttttccgtcccagtggtaaacaatatagcccctagaaagcgttatcaatggaaggtcctgcctcaaggtatgttaaacagccctaccttgtgtcagtattatgtggcttcagttgttgagccagtccgaagacaatttcctaaatgctatattgttcactatatggatgatatactttgtgctgcaccctctcagcagcagctgactgaggttttccaatgtttacaaacctgtctaaaaggagcaggattggttattgctcctgaaaagattaaaatgaaaagtccatatcaatatttgggaactgtggttgaacgtaccactgttcaccctcaaaaggtagaattgagaagagatcaaatttctacattaaatgatttacaaaaactgttaggagacattaattggctccgaccttatttggggattcctacatatgaattgtcaaatctcttctccttgcttagaggagattctaaattaaacagcccccactctctaactgcagaagcggaagaggaactaaaaaagatcaaaagtaaaatacaaaactcccaactaagtcgggtcaatctaaaacaacccattcagttagtaattataccttctcctcattctcccacgggaatattaatgcaattagaaaatattctcaaatggctttttcttcccagtaatgtcacaaagtctttgtctccgtacctggacttgatggcacaacttattctaaaaggtcgcactcgctgtgtacaaatgtccggaaaagatttgaatcatgtaattgtcagtttacttattaaggaaatgcaaaattgttttcaaaatcatataggttaggaaattgcctttacagagtacgtaggatcaatagataatcactatccaaaaaaccctgttttacaatttataaagcgtactcaatggattctgccaaaaaaggtggagtcacccatcattgacgcccctgtgatctttactgatgggactagtaaagggaaggccggatatgtggctaatcaatctaaaattataagaacacctggcctttcagcccaacaggctgaactaactgctgtaatccatgccttgagggattatcctgagcctatcaatattctttctgattcagcatatgtagttcatgctgccaaaatgattgaagctgctaccattaaacaaaatttacctgtcttgttatttgacttgtttacaaaattacaaactgttgtaagggaaagaagatatccattttatattactcatatcagagcacatactaacctacctgggcctctagttgcaggaaataaagaaattgactgtttggtgacacctgtgttacaagaagctcaacattttcatgatttaacacatgtaaatgttcgaggccttaaaaaaagatttggaataacatgggctaaagctaagacaattgttcgtcaatgtcctgcatgtcaaattattaacaatccttctcaatctgagcctggagttaaccctaagggacttgtcccaaatgctctctggcaaatggatgttactcattattcatctttcggaaaattgtcatttattcatgtatgtattgacacttactctaaatttatttgggctactgcgcagtctggtgaatctgctaaacatgttattcgtcatttgtatgcctgttttgcagtcatgggcctgccacaagcaattaaaactgataatggtccagcttacaaaagacacagaaatagttaagtcacaacaaacacttttaaacaaaaccttattcactttaaattttttaaacttggcctctgatgaaaaaacagctgcagagagacatttttatacagaacaaaataagattaactttcctcatgctgaacagcccttgatttggtggcaggatccactaacaaacttctggtctccaggaaaacttattacgtggggtaggggatatgcttgtatttcaccaggtcatggattacaacctgtttggattccatcaagaagaatcaaaccatatcatgagcaagcttgtgaagcatccctcgactctagaccccagaaggaagatgataagggctcatcttcccacttggggtcagatcaaacatctaacccgagaagctgaaaatctactaagaaaaggaaagcctcccactccaaataatttggtcctagctctctttactttggtttccatcacagtgagtattctcacaactggcatagaaatcattttattacttgtatagtacaggaattaaaagcctcatgagtaaaacccattaaaaactattgaaggtttaacaagagagtccatcagctttcttagaaggactcagaagggcattgagaaaacatacaaaggaacccagaaacaatggagggccaaataattcttaaggataaattcatagctcagccggtgccagatatatggagaaagctccaaaaaattggcttttggccctgatcaggatctggagcacctcctcagagtatgttataatcggggccaggaagaatgaaaggagaacaagaagagagactgagaaaaggctgaggctctagttatggcgctacagggagtcaacctgggagtctcaaaggtgagaggactaggcctggagtctgtttcctctgaggaaaagagggaccctttaaatgggaatgccccgagactcagagatcactggaagagggattgcccctgaagacgaaggtctctgtggttgacccctcaagcccaggatcaagactgatggaacatttccataatggctcctgtccttatcacaactcagccctgggtgactctaaatgtaggaatacagagccacttttcagtcctcctctccaatcctgggcccctccctcatgaatttgccacatttatatttctggcaagccagttacaaaattctttacacaacctttgagctgtgactgggaatccattttcttttctcaatacctttctgattgtttcagagtccaacttctcttttagaaattcttaaaatatggaaggtaactacatacacattgttacagttgtcaacattaggtataatatattaccatacctaggtttaacagaagtcaaatgagacactgaaacatcagttactaaacagaaactaaaggtctttagaatgatgaaacaatatgatcagtgccaccctgagatggtctctataagaaaaacttgtttttagaaattataaaggagagtccatggttgttttagaaaagtaggatgagtgtgttttcaatatagaaggaataaggaatggaattgcatcttattaaggtaaaagaaagatagtctgtcttcagctgattgctctccttgggaaataagggacagactaatatggatacagaaagtgatataaggtgtgtggcaagtggacattgagaagagaattttgaacatggtggggactgtttagaaatatttgagtaagttaactttaaggtgatgccataaatcatactgttcaaaaggacataaggtagctttccattgcatgctgaccaaggcatacaaatgtttcataaccagccagagaaatcagaagaatcatgagttacctgtgctattataaaatctaaatgttgtattcctgattgttcacagaatgtgtctaattccctgctagatcatcatcaatagattcatgagctgtccaatccagctccagcttttggagctgccctgtggaacccgctgacctcctcctcctggtgaaaatatttctttgaggtatccaaagcaatgttatcaaagtccacttgaccattccatgagtggagacctaactgctttccctaacgacgccccttttcagcaggaagtagttagagcggtcatcgccccttttcccacagttagagtctccaactcaaaggggggaattaaggtagatttttaactcaggtagtcagtgtagggatatgggctttgatacattctttgtggctatttattaacatttgtaaattgagggtcgcatagcaagcccaactgctataaaggttgcaggtattgccccatgaatccatcacatcagaatgaagaaggttgcatccgctgctgacatggacaccagggaggctgtacagcacctcgagaatcttcatggtcaagttccagagactccttttgccatcatcagtgctaagccctgctctggccacctgtggaagctggtcagtctatgcacagcagaagcctgaggagttccacgtgagacttaacctgaactctgagacaacttggactgtgttctgtctaagcgaataattcaagaagaaatgaaaaaagttgcaagacctatttttgtcttcccacaaaaacaaaaagggggagatgttgcaagacatgtttccttgaaaactccatcttgtccttctttactttatcctatcttcttgtcttattttatcccatcttccttctttggaaaaatagtcacagtgctggtaaacgacttaagcttaagagcaaagacctaaaggcataaatgacttaagcttaagtactgttatgtgcctagaggtcagagtaagagcttaaccctttaccacctaagtggctttttaaatagtaaaagaacttatataatagtaaaccctgtatgatccacccatagccactcctcacttgatctcaca

SEQ ID NO: 219 - DNA, 7982 bp, artificial
  ss1985 sequence
tgtctgcttggggatgggggaggtccgggatgcttacatgggaaaatcaagaccttgtagtgtataaaagttactgagaacaaagacctggtgctcagactctggaggtgactcctctgagcctgcaccggtgctgaataaaccttgcttttccatatctccgagtgctgtttgtctccttccgttgcaacagtttttgcggtttctgcagcattttggtgcgttggccgggaagccgatgacccagctggcctcttgtgccaccgttgtcggggaacctgggggaggccatggtcgccggcccggtgaaaagtggatagcgcgcactggccattttgctggatccagaccctcactcgggccatgctggccttggcccacaccgcttcccgaatggactcagaaggagagtggaaacaggttccaggacaggacgttgggctggtgaatgccccggggacatctgcctaagtcaggacccgccatacggtggaaggagagactgatcacctctcagtgaccaaagggtcactcaggtcagggtttgctgccttggtattggaaggcttgtcaattctggtgtgtgtgtgtgtgagtgactggagagaacaagagcccatgctccaccatctttggactacagagccagagtgagtcctgacctgcagttccgcagtgacccttatacggcttatggtggccctcttcagggggatcctgacgttggggtttatacagtcccacctatgctaagaggcgcctaaaatatctcgtccaggggagcgttcaggaggacgaaacaattgttacctgaggccttgtcctcactctttgtcttgcgtcaccggcacagggtgggactttacacagtgggtaaattggcttccaagcccgctgtcttagagtgtagggttaagaattttaagaaaggattttctagagattatggtgttaagctgagtcctggaaaactgtgtaccctctgtaccctagagcggccctcctttggtgttggctggcctccagaagggaccttagatgtgttcacagttacagcagtatataatgttataacaggagaccctggacacccagaccaatttctgtatattgatcaatggttggaaattgcttatttgaggcccccatgggttcagttctacaccacagaccagggacagtgtagggtgctagtagcccagtccaagaaaaaaaaacttgtctcaaaagaaggtgccacatatttatcaagagaaatctgaggactcgccccctatgccaccaccttatgtgctgccggccccacctccaggagccgaaggtccccagatgccagatagcccactgccttctgtttctcctcctccttctgcttctgaagttcccgaggcaatatcacccctgcagccagattctccagaacctatgagcaggtgtctccattcagctcagggagcagccactccagcattacaaatgcccttacgggagatatggggaccacagcaagtcgcccccgatgggaccatacaagaggggggacgtttttattattaccagcccttttccactgccaatctcctcaactggaaacaccatactccctcatattctgaaaagcctcaggcactgattgatctcttagaattcattttccagacacactgtcccacctggatagactgccggcaactcctttttactctatttgacactgaagagcgctggtgaattgtaacagaagcccaaaaatggcttcaggccaatgcgggggactgagcagacttggcaaactgggtgagggaagccttcccagaaaaaaacccccactgggactatgacactaaaaaaaaaaaaaaaaaaaaaagtaacctagagaggtaccggcaggccttcctacagggggcaaaagctggggctaaaaagcccactaatatagctaagatcagtgagatactacaagagccgaatgaaagcccagccaaattctatgagagactatgtgaggctttctgaatctacaccccttttgatcccaaggcccctgagaaccaacagatgataaatgctgcctttgtgggacaaacccaatcagatatccgtacaaagctacagaaattagaaggctttgcaggagagaatgccactaaactgttggaaatagccaacaagttttttattaaccgagaccaggtggcccgccatgatacaaaaaaaaaaaacaaaacaaaacaaaaagtgactcttctggcagccaccctgtcaaaaccggtgcccccagtgggatcaccctgtaggggacaaggcccaaggccaggaaaaaggagtcccctggaacatgaccaatgtgcttactacaaagaatagggacattgaaaaaataaatgccccaaccgtcctgaaaaaaagaccaaggccccacctagccggtacccatctgagccattcagcgccaacctgattggcctagctgagtctgattaggggggaccaggctctctccaactgggcccctgagagcctatggtcaaaattcaagtagggggccaccccatagactttatggttaacacaggtgctgaactttctatggttacacaacctgtggctctcctcttgggaaaaaaacccaccattgttggggccacaagtaaccaaacccacaggcccttctgtggtcctcgacgatgtcggttaggaggccatgaagtaatacataaattttttacctgcctgactgcccagtcctccggatgggaagagacctgctggctaaaatggcacaaatttccttttctactgatggatcagcccatcttaaattgacagaaccccccctctcctttaatcatggctcttgctgtaaaaagagaagagaaatggcgcttgtactcttccccttcagaaatggggaccgttcccccagaactagagactaaatacccattggtttgggcttaaaaaaacccaccaggactgacaaaatgccacgctcctgtcttaattgatctaaaacccggagctcaaccagtaaagctacaacaatactcaattcccagaaaaactcgactgggaatccaggttcacctggataggctgcttcaacctggactgttaataaaatgtcagtccccttggaacacccctttactgcccgtgaaaaaaaccgggaacacaggactactgcccagtacaggacttgagagccataaatgaaacaacagtcacattacacctgtccgtccctaacccatataccctactagggctgatcccctccactgctgagtggtttacttgcctagacttaaaagatgcctttttctgcccctgggtggcacctgccagtcagcccttgtttgcttttgaatgggagaatccacatacagggacaaaggaacagctcaccacaaggattcaaaaactctcccactctttttagcagcgccttagctgctgacctggctaaatttcctggacaaaaactgggctgtgttttgctacagtatgttgacgacctcttactagctggcaccacggaggctcagtgcctagagggaacaagagctcttctttccctactgatggaggcagggtatcgggtatcaaaaaaaaaaggtacaaatctgcaaaaaacaagtcaagtatctgggcttcaacatcatacagggccgaaaaatactggggactgaaagaaaataggcagtttgtgccattcctgtccctaccacccgccggaaggttcgtgagttcctagggacagcaggattctgccggatatggatccccaggttttcagacctggccaggcctctgtatgaggctctaaaagggcaaaaaaaggctccccttgaatggggaccaagccaggagacagcgtttcagacaatcaaaaccaaactcactgaggctccagccttgggacttcctgatataaccagagaatttaacctttttgttcataagaaaaatgtgatggctttgggagtcttaactcaaatttgggccttggcagaggccagtgacatatctgtctaaacaaattaactcagttgctgtcggatggcctccctgcctccgagccctggcagctatcaccttgttggtaagaaaggctgacaagttaaccctgggacaaaacctcaatgttaaagtcccacactcagttgtaaccctaatggataccaggggccaccattggctcacacatacacgaatgactcaatatcaagggttactttgtgaaagtccacgggtaaaactggaggttgtaggaactctgaacccagccacttttctgccagataaagcggggcccccagaccataactgcctggaggtgctagatgaggtgttttccagcaggcctgacttgaccgataaaccactccaaaatcctgacctggttttatatactgatggcaacagctttatggaggatgaaaaaaggatggtaggatatgctgtggtatctgacttaaaagtgatagaagcagaggtgctttctcaaggctggtcaacacagagaacagaattatgggccttaatcagaacactggaactcagtcaagaccagcgagttaatatctatactgactcacgataggcctttacaactttacatgtccatggagccttatataaagaaagagggctcctcactgctaaagcaaaaggaattaaaaaccagactaaaatcttacagctcctagagacagtatgggaacctaaagaagttacagttatccactgtaaaggccaccaaaagggggataacccagtgacaaaaggaaactgtagtgctgatgcagctgccacacaggcagcccggggacaacagccagacaaacctaaggttttgctggccccagaagtgccagctgtccccaaatatcctccagaggaagaaaaatggataagggaggaaggaaaaactaaaactaaaacggggtggtgggtcacatgggaccaccgagtttacattccagaacagctggcctacaaactagtccaccaagaacatgagctaacccacatgggcaaaactgccttagagaccctactgggccggtactatctcattggtcttcttcctacactctgctcctctgtctcccaaagatacataacctgtttacaaaataatgcccgccagggaccccacagaccagctggggcacagcagtgcggactgtccccatttgagaatataaaagtggacttcactaaggtcacccctagtgaggggtacaagtatttactagttcttatctgtactctttcaggatgggtagaggccctccctacccaaactgaaaagacaaaaaaagtaaccaaaacactcctgagagacattattcccagatatggaatgcctctgaccatcgggtcagataatggaccggcatttgtggccaaaacagcacaacaggtgacaaaagctttacagatcagatggaaactacattctgcttatcgccctcaaatttcagggaaagtaaaacacatgaaccgaacccttaaacagaccccggcaaagttatgtcttgaaactggcttgccctggatagacatgttgccggtggccctcttaaaagtgagatgctcaccccgagtgggaataggattctcgccatttgaaatcttatatggaaggccacctccactaatcagtttaaaagaagacaccagggagttgggagacttaaaattacataaacaattacaaggactggggctcactatttcttggatacataaatgggtcacagacaaaatacctgtgtccttagataaaacagtacacccccacaagccaggggaccaggtgtggataaaggactggaaaaaggagcctttaagtccggtatggaagggcccctatactgtaattctaaccacccccactactcttaaagtaacaggaatagatacttagatccatcattctagagtaaaactggctggcacagctgatgactgtggagagtgggagactgccctcaatccggagagaccacttcgcctgacaatacagagaaggagacgacgatctcaaagccctgctctgaccacaccggaagctggtcagtcaacacacggctgaagcttgaggaatcggttgcctgtgagcccaaataaaaagagggtttcaaaataaacattcacattgacgaaagaggccttgaccctggagctgtgctacatttccagagaatcacgtttgcgctccaaggtgcctctcacagtgtctttcattccttttatgaagagataagaaacaccccacctcccattccagccacaactaagaacttgttcttagccctggcagaaactattacacaaactctcaaggtctcctcttgttatgtatgtggggaaacaaacacaggagaccactggccttggcaagccagaaaactgaacctattagagcctcataatgagactatggggtcaccgatggggtatggctcctcaaaactgctattataggaaaaaattgtcttgcgaggtggggaggacagtttaatgtttcatttggaagcctaacatgtttaggcctaaggtataataatctgactgcccaaaagactcaatagtagtcatcctccaatctctcagagcccaaacctaatcccttgtctaccttttccctcctttgacaagcatgggaggatatcaatgctaatatccagtggcaggcaccaaagggattatattggatttgtaaaaaaaaaatgacctattccatactccccccaaattgggctggggcatatatactgggaacaatcagaccttccttcttcctgctcccactgtcactaggagagcaactgggagttcctatatatatggcacagggtgcccagagagacaggaggggtctccaaattggagactggaaagatgataaaaggcccccagaatggataattcaatattatgggcctgccacctgggcagaggatggctcttggggatattgcacccctatctatatactaaaccacaccatcagactacagacagttttaaaacttaaaacaaatgacactacaagggccttaactatattggcccaacaacaagctaaaatacacagtacaatctaccaaaatcgcttggccttggattatttacttgcttctaaagaaggggtttgtgaaaaatttaacttaagtaattgctgtctacaaatagatgacaccagaaaagtggtagaagaaattgctgacctcatggttaaactagcccatatacctgtacaaacttgaaaaaaaatgggatgcagacagtctctttggtaaatggttctcttggttgggaggaattaagacaatggtcaaaatagtcatggttatacttgcagggtgcctacttgttccctgccttgtacctctcctgataaatattataaaaggttttataaaaaacatggttaaaaaaaacagcctcccacctgctacttattagaggctaccaaagggttatgactgatgatgatctgtaaagggtgcagatgcaccctaaacatcaagaggggggaatgaaatggagttttaactaaggaacaacccccgcttggctaagaaggcagctgcaagcctttccagctgtgctattcactatgccacccttctcataataatgtaacaactgtgtgctctctgtccaagccagcagccctactaattaggtacccagcattgcttatcagttctgcttctgtaaccttgtttgctcagtttcttagggaggaaaactgtctgcttggggatgggagaggtctgggatgcttacatgggaaaatcaagaccttgtagtgtataaaagttactgagaacaaagacctggtgctcagactctggaggtgactcctctgagcccgcaccggtgctgaataaaccttgcttttccatatctccaagtgctgtttgtctccttccgttgcaacagtttttgcggtttccaca

SEQ ID NO: 220 - DNA, 9283 bp, artificial
  ss1994 sequence
tggaccagaccccaaccacagtcccatgattatgatacaacacacgacccctgtcctatacaacttaactcttcctaagtggtggggggcctgagttctttctcagtgccccaggccatctctctggtcaataaaactttctcgagacatcttgctccagttgactgtcttttcttctctcctgtgcactaacattttggtgctgaaacccaggagtgttagccggccctccctttctaatttccaggcttctcctaatgctccaaggcttagaggaacaattgatgacaccacccagggctactctctgggggtattctgaaggtacttctaggtcttgggggcagtagtttttagcccaaaagggtggaaacctcctctgttcttaaactcttttcctgttttctatcccctaaactgaagagcctttcagtgaatggagagaggctattggaacaactgaagactcaggccagggctactccctggtgagctctgaaggtttcttcagttctttctcccagcaactactgctcatatgagtgaaagtctccctctcttctttgtgactatggagctctgaggtctcaagtgccttctgatgattaccaccaccccccaacacactccacactggccttcatttcaaaacgagtggaaggtgagtgaatattgaagctctcctcttctatttttcttttgtctccaacccagactgatcctactttcataaagtctggatgtccagtcagccaggtcctgacttgtcccaggggctggttgatccccctcctctggaaagacatttcctgatcaggacagagcctctgtctcagatctcagacttccctagggggatacccttctgattgggtggattccctagttcagatcctaggacctctcagtgggaagcctctcagagcacctaggtgggctaaaaggctccatatatcggccttccactcccaaattaatgctacgggtgcctccttttctctccctccatgggacatacttctcagttgtcttcttcataacctttcaactctgggacttctcccagatattaagcccaagggtctcattttcttctgcaatatggccttgccctaatataaattggataacagaaggcaatggcctgaaaacagcacatttttgattaccaaattcaatgtgatctagaaaattttctgcaatgcaatgggaagtggtcagaagttccctacatccaggcgtttgtctacctaaggtctcaaccctctctttgctctgactgtaactcatatcaggttctcctactaaatgaacatcctctcgcagtctctcctcacccttcccacaagctgaatccaaatatcctcctccctatccttcttccatttctttgaccccataaatgcctcgttcccactctgattcctcatgaccctgaacccctgcccccaaatcccccccccccagccataatccccccatgaccagatcccacacaaaaaaaaatcttcagaggcccctctccttgctttaagggaggtcacaggagccaaagacactgccagagttcatgttcctttctctctgggagacttatcccaaatagaaaaatgcctcaactcctttatctcagatcccactactcatacaaaagaattccaggagttcccgtcatggctcagtggttaacgaatccgactaggaaccatgaggttgtgggtttgatccctggccttgctcagtgggttaaggttccggcgttgccatgagctgtggtgtaggttgcagatgtggctcggatcctgcgttgctgtggctctggtgtaggccggtggctatagctctgattcaacccctagcctgggaacctccatatgccgcaggagcagcccaagaaatggcaaaaagacaaaaaaaaaaaaaaaaagaattccaaaaatctcattcactcctaagacctgacttggcaagatatatatgttatccttaactattatccccctgaagaaaggaacaaatttggctggtagctcaaccccatgcagactttcaagatcctgctaacaatcccataggaactctggctgtccctcatgtggaccctaattggaactatcaaacagactccctagataggcaaaagagaggccactttatctccttcctaatagaggatatgaaaaaaatgctcattaaacattgctaattatgataaaattagagaaataatacaagagccccaagaaaatccagctcttatgtcacatcttacagaggctagtcttaaatacaccatcttaaacctagaagtgaagagagtaagacctatcttcacatgcactttagctctcagtcagtactagatataaaaaataaactacagaagctagaagatggccccttgaccccacaaagtgaccttattaaagctgatttaaaggtctttaataataggaagaagaaaaagccccaaaactaaaacaatccataactaaatatcagcttcttgctgctgccatacaagaaaatcctcaaaaaataaaccaaggtccccaactaggtatattaaacacaaagaataaaatgacacccccacacacacacaccaggggcctgtttcaaatgtggttttgagggacattggacatggggaatgctccaatctgaggcctctgtcaggcccttgccataaatgtggccaaatggtacattggtagggggactatgggaagcccaggcagaccattgctgccccaaccccatgaaatctgctgcagagactatcaacatgcacaacttgttgggcctggccatggaagatttacagggcccaaggccaccaggcccccaccctcttactaccactctagagcctcggagatctatggcagtagcaggtaagactgtgtcattcttactagacacagggcacatactctgtactaccagttttcagggtataacctacacctcccccacctctagatcgattacccactataccacaacagggtgaacctttaatctgcacactctttgacaccactttttgccattcattcctagtcatccccacataaccataatcctataatcgggagagacatcttaattaaattccaggactacattcaattccccacaaaaaccaaacacaaaattatactcttatgccagccagactcagagcttgcccctcccagtcccttctctctcccctctgatataaaccctattgtttgggacactagtatccctacaattgctagctatcactctcccattgtcataaaactaaaggactgtacataattccctaaccaatctcaatatctcattagtctagatgctaaaaaaggcctaaaacctatcattcaatgcctcctaaagggtaatatttttaagcttactcactctccatacaatactcctatccttcctgttaaaaaacctgatgggtcctttaatttatttcaggatgttcgcctcatcaatcaggtagtcctacccattaacctggtcattccaaacccatacactctgctgtctcatatcccttctgatatttcttatttttctgtccttgaattaaaagacgacttttccatgattcccctaaacccaacctgtcagatttattgatttattgatttatatggactgacccgaacactctctcagctactcaactgacctggacagtcctctatcagggttttagagatagcccacattcctttggccaagtcttagccaaagacattagccaattttacataaaacttagtacaatcttgcaatatgtagatgacctcttgctttgaagcccctcattctttcccttacaacaacacacttctctccttttaaatttcttggctgacaagggatattgggtagcccccttcaaggctcaactatgtcaataaactgtcttccatcttggacttctcttaacccccccacacacagctctcactacagatagaaaagctctctttgaacagatgcctatcccattaaacaaataagaagtcttaaacattcttagttctggtaggatattttagactattgatgcccaattttggaattttgacaaagccactttacaaggctccacatagacccatcgaggaaacttcaggaccatctatatccattaaggatccttttcaaaaattaaaacagacacttctcactgccccagccctgggatttcctaactcttctaaagaattcttactctacatacatgcaagagagggatttgctgtgggtctcctgacacaacaatatggaggtgaactccaccccatcacttacttgtccaaacaactagggtcagtcatccaaggatggcctctatgccatctaccttattaacgtatattattaatgtaatgtatgcctctaccttattaattccacaggccccaaaacacccttctcattgaggacccctttaaaagatgttcaacccttaacccagcttccctgctctcccaacctctctaatctattgactgctttcattcctgtattgaagtagttgattccttattaaccccctttcctcaactatctgaaaaacttataccagaaacacctaatcagtatacagatgccagtgcaagtaatacttccccacataaagcaggttataccattgtcacagaaacaaaagttttagagtcctctacactttcccttggaaccacctctcaacaagctgaattagtagtggctttgactcctactttagcactagccaaggacaaaatcataaaatatatatatagactttaaatatgcttatcacatactccattcacatgctgcaatatatggcaagaatgaggtttcttaatgacccaaggcactccaatagtcaacagataccttatacaccactgctatgggcagcatgacttccaaagaagatagcaattattcacataaaaggccatcaacccccctcttcaccccttactggggaaatgccctagcagataaagaagcaaagagatatgccttgaattcccagcttccccaaatcatcccattacaatcaaacttcattaaccctcattataatcaacaagaacatgactacacagaattaggggcaaagacacaaaaccactgcgtgactctacacagcaagcctataatccttaaagaacaaatacatgacatactacaactcatacataatcagttccatgtaggttttagacctttgctaatatcccaagtgattactcaaacttggaaaaggtcacatagtcatgtaagatgtgcttccaatcatcacctcaaggtcagattaggccacctccatttcctacacatcaggctcaaggacacctttctggagaagactggcaaatggacttttacccacgtaccccaaataaaacattttcatcatttactcacctggatagacacctttacagggtggattgaggcatttccaacaactaatgaaaaggcatctgaagcagcaaaagttctattaaaagaaattctgccttgctttggccatcccaattctcttcaatcagacaatggtccagttttcatctcaaacataatttaggaactctataaactcttaggaatccagtggaattatcatcttacttatcatccccagtcctcaggaaaagtggaaaaagctaattccctcctaaagcaacaactaaccaaattaacccttgaaacacaacaaacagattaccctcttgccattagcacttatgtgcttatgagctttacccagaaaaactctagagataagtccttttgaactaatgtatggaagatcatttatttacaacaactagccacaggcaaccccaactctctattttctaaaatatggcctgccctcatttaaccagccatctacttagacaatatgtaaatgactatttaccctctcctgtacggtactatgatccttcgactctaattctggaacctgggtttggctaaaacatagggtttctgttaacacccagatggactggccctttccaggtagtgctcaacatccctagtgctgctaaactaatgggagaagcaggatggattcatcacacccagcttcaatgagcctccaattctgaactagacaccctctcattacctcctccccttatccaacttcacctaaatagaaagctactcagctctctgctaccagccagagactttcctgaattcctgaagaaactgacactgactccttggcagcagaaaacactgccacagctgaaactactacctgaagacaatctccactgatcatttattaagctatgactaaataacaaggcctagataagattctctttaacctggtcattctcttagtcctcattttggccatctaatttctatttgctctcctcacactcccttgcaaaacagttccctggtactccacagactgctttcgtgaagtacatcaagtactctggggaaagaaaatcactcaaaactaacagaacctcgatgacagatcattactccctcaataaattagaaccaagaaacacctcacaaactttctaaatgtcataattgacaacctgacatatgactcttcataccacctaactaaccacagagacctcctttcttacatcgctgacctttggctccaaggtgatttcttggatatccttctagatcttttgacatggcactcatttattctatgtcttctaacatacaatttatttaatgatcatatttaaactcatcctaatgtcccaagctctctccccacctaatcccttcattacagacctctatagatattgtctcagacattacccacaactcctctttaccctgttggatttgtattcctatcagcacctgcctttcaagcccgtcctgcccccttataggcctaggaacagactcaggttttccttaaactataagaaggagatgatatctcagattttggtaggtctaatttgtttaaggtctaatttcaaacacaggtctctcctctcctgtcctacatcattccaatttcaggacagcaagggtatttatcagcccctttagtggccaaggtccctctctgtatcagaagaaaaccttggaacgtaatttcaggagaaaaacccttggaaatatggacctcaggtattgtaatcttacgatagacctatcaccccaaagttatcatgagtatatagaggctgggacctcaagttgagcaccaaggcctacagcactatggggaatatggataggttcatatggcttatatttctgtcagggatgaggaatctggtccttaaacattaacccagataaccaatacactctccaattcaaacctgatcacggtatgttattaaatttacctgcaccctatagagcattcctggacatagcacaacataggatagatactgaaaaccacacccctgaggaaaaaacaaatccattttactccaaactttgagaacagcccacatagcaatgtcagttactatcttcagttttggtgttcctcaggtcattggaggaaatcgtagaggatctggacaatggaaacatgtagtaacctatcatctcacaggctgccttgattttggacaagggctctttttcctttgtggtaacagtatatatgcatacctaccaactaactggactgaatcttgtactttaacctttcttgccccacccatccaatgttctctagaaactgatcccatcccaagacccatctcaactttattaaggccaaacagagcaatacatttactatgcctattggccaggatagaaatcataactgcaattggaacaggaacaaatatctaagtaaggtccttaaggaaataacagatctattgacttatttacaagatcaaattgactccctggccacaatagtactacaaaatagatgaggattagacctccttacagcagaaaaagggagaatttgtgtagccctacaaaagagttgttgtttttcaaaatcaaatcaggactggtcagagaaggcataaaatgcctaagagaacaagcaacctggttccaacaacaggggacccagggcttctggccttctgcctcctccttaatctcatggctagcccccattctcataactctcatccttctctttgttctgctaatggccgggccgcccctgtttcatgttttcttctttttcacagaaaaccattgaatcagtcacagacaagtgagtcaactcgaacttggctttgcagaactacagataccaccagactcccccaaccataaccctacccactaactgatggccctactcaacaggaagaagctacagaagaagagaccttcactccttttcctattaaaaacagagaggaatcttttagatggaaactctggacaataaaacagccataaaagtgtcatcatgagctacagatctgctccagcctgtacttgccagcacctcagaacgctatcagacatttgttctatcggacattgttctatttaaactttggccatttattgacagatgattcaattaggaagatgtggtatatatacacaatggaatactactcatacataaaaaagaacaaaataatgccatttgcagcaacacgaatggaactagagactctcatgctgagtaaagtaagtcagaaagagaaagacaaataccatatgatagcacttatatttggaatctaatatatggcacaagttaacctttccacagagaagaaagtcatggacttggagaatagacttgtggttgcgaagggggagggggagggagggggatggactgggagcttggggttaatagatgcagactatttcctttggaatggattagcaatgagatcatgctgtgtagcactgggaactatgtctagtcacttatgatagagcatgataatatgagaaaaaggaatgtataaatgtatgtgtaactgggtcaccatgctgtatagtaggaaaaaaataatgtattggggaaataaataagataaaataaaataaactttagccagctaaaaattaaacctcccaccttgaccagaccctaaccacccttttatgaatatgtgacttgacacatcacccctgccctataaaacttaactctccctaagtggtggggaacctgagttcttactcagggttcccagccaactctttggtcaataaaacttgcttgggacctcactaatatagttggctgtcttttcttctctccttcattctaaca

SEQ ID NO: 221 - DNA, 4890 bp, artificial
  ss1998 sequence
atgctggggagacaacaattaactgaaatcataaagactatatgacataaaattcccatttcagaccaaggtactggttcctttgggaatgtcagacaaggggcctaatcatccacatatggaatttataaatcaattacaagaggccattagtaggtagatagttaatttagaggccgcagagactactattatctttggcagtagaaaacgccagtgaacactgtaagagaattttaagaggcatcaaggtagacaaagacaaccttacttccacaatagcacaatttataaaagtgcgccaaaatgtggggactgaatttcataaagtgcagctactagccttagcccttaaaggaaagcctgataactccactattaaatgcttttcgggaggaacagggccattaaaagggaaaaaacttaaacagctaaagaagttaatctcggaacaattggaagcaggacatattgagcccagtaacagcccctggaattctctggttttctgcatacctaaaaaaatcaggaaaatggaaaatgttacatgatcttagagcaattaatgctgtgattgagcctatggggcctgttcagacaggaatcccttccccttctatgatcccatcagtttgaaatgtcacctcaaagactgtttctttaatattccactaacagaatcagattttaaaaatttgcttttactgtccctgctataaactttacacagcctgaggttcaatatcactgaaaactactgccacaaagaatgttaaacagccctactctttgccacctttttgcatatcaggctttacagcccattagatattcttttccttctactcaaatctgtcattatacagatgatattctatttgctcatcctgattctaaagaattagataatataatgactattttgccaactatacttcgtgattatggcctctacattatcccagaaaaagtccaaaaagctagcccatggaaatacttgggacagactatgttagctcaaactattaaacacagatacctcaaataaaggccaaagtaaaaaccctaaatgatgtacaatgtttactaggtacaatcaatcggctacgtccaatgttaggtatttacaatgatcaaatccaacacctaactgcccttttaaagggaactgaaaaagaccttgatgcccccagaaacttaaatgatgagtcactattgaaattacaacaaattaaccaaaaattacaaaagtgctcacatgacaggagaatcgcacacttgccctttcaacttttgattttgcccacagcccagtggtcaacagctttaatcacaaaaattgtgcttgcttgagtccttaaaattgaatggttgtttttgcctttgacaaaaagaagtactcttacacccatcattacaaatatttcagaacttattttacaagtgtgaaaagacttttagagttgagtggggaagattttgaaatcatttatttaccagtacctcacaagtggtttgaaggaatgttacaacaatctctggaaatacaaattgccttagctgactatataggtcaagtttcttatcacttgcccaaagaccctatgttaaaactacatagtgaaattgagatgattcattttccagttctacaaaaaaccccaattaagaaaggtcaatatgttttcactgacacatctggaaaaaatcatatgtatggttacacttggcattttaacaataaatgacattccatcagtgggcaggatataggctctacacaacacgtggaattaatagccattattaaagatttacaaatgtttcctgagccacttaatattattagtgattctcagtatacagtaaaccttattcaacaaattcctaaagcaatattaaagttacctaatgatgagagatttgccttactgttttctactgtttatactttagttaatacccggacacagcctctgtatttgattgatattcgctcacataactccctgctggaatgattttatgaaggaaacgaaagagctaataccctcgtctcttgtttccctgtaagagaggctgaacaatcacattccttattccatgaaaaatagatatctcttaaagttttaacatttcatcataactagataaacaagttgtctgggcatgtcctgactgccagtttctgtcacagcaccaatcctaggggagtacaacctaatgccctctggcaaacagatataactcatgtcccagagtttggtaaaaaaacaattcttacatgtctcaattgatacctattctaaggttatctttgcctctgtgtattctaaaaaaaacatccaaagttcctataaaacatttattgcctgcctttgcaacttggggtaagcctcgagaattaaaagcagataatggtccggcttataccagtcatacatttaaaaaattctgccacacttgaggaattcaacataaaaacggacttccatacaatcctactggtcaagtcattattgaacatgcccaccttacactcaaaaccctcattaaaaaacaagccaaaaaaaaagggagtccgatatgatgggctattccacccccagaagtacaagtcaatatggctctccatacctataattttttaagtttggataatcattattcatccctggctggtagacatgcctctgttaattcctttaagattaatccaaaagtactacgtaaaaattcagaaggcggcccttgggaagtgcctgtggacttccttacttggggcagagagtatgcctgtgttcttacccctacaggtcctcagttgtgtctggccaaagctgtaaaaccataccatggattggtggaagcaaccagggcttccagtcccccgggatcagatgatgatgcagatggctgacgtgcatttggaatcatcacttgttgatccatctatgggtatacaaggcacagtgtccaccacccgcttggcccctaatatcacctggggaagcattaagcgcctaactcaacaagcatgtttgaggctagagagctgctgctgcccattaactcgggaaaatatgtggctgactatgattaccatcattaactttaacacagaagtaataaaaaaattatggtgggtccttctttccttaacagttgatgcccaatcctcctatatttgacgctattacttggaacgatctgaatatcccattaagtcataatgccttccacttcatgggaggacaaaattttaaccaaccttatatcaaagacaatgaacactggatcacagttaatgttagatcctctcttttaaaatgggaatcccatgacacaccaatatgtttaacaaatcaaacttctcttacaaataataattggtgtattgatgttcttccacattggtatctccacttcaaggaaaagaaaaaagacagccagctaacatgacaattatcagagtcacagtttttcatatttttaataaagaaaatatctctatgtcccctcacgaatacccgccttgtgtctcaaaaaagagcttctcaaaacaatggaataaaataaatgggcaccctgtacaggggattggaaattttatcataaaaataaagatcatatgtttatagaccaagggcctcagggacacttagaaggcagtgtaagccattctcagataaacttctttcaagcaaaaaatgagaccatttcttggaaaggcaatggtctgtctggtcctataataacttatgtaactaataacaaccagattatttggcatgaaaaattatggagaccggggttgatttggaaccccctactcatttcccacagtgtttataagagaatgggttcctttaagcagattctgctggttaataacataacaccaaccatcatagtatgtaccccttctccttatgtctttttcataactacttctcctattctgtcgttcagctataccacaggtaagtataaagtcaaggactctaaggaaacagtcttttcctgtattgggtataaaaacatttcttctgagttttagttgtttgtccttcgccagagaccttatttgttgttacctgttaatagttctgaaccttatatacctccatctggcactggacttatgtgacaaattgtaaatggttggataaaaatgagcaaacaaattcggcgttttatagggatgttaattttgggcatcctagctgatgtgactttgatagcctcagcagtttctgctggaattagtcttcatcattcagtcactatatacaccatttggatcaattcatgattaatactactaaaaaacttatcactcaaagtaatactgacaggcaggtattgagccagctggatgccctagaaaatgctgtagagttccttggccaaagacagcaaggcattatatatcaaatgaaacttcaacgtgaagtttctctcatgtctgtatgaccgctctcgaatgtaatcatagtctttcatgggaacaagtccaagcccatcttaggggcagtttctgccccaatttatctgcagacatagaatcattagatgttcttcttcataaatgactgttaatagcccaaaatcaggccaaaaaagattgggatcaatcctggattgaatggatatcatccaacccctttggatctctacaaacactccacctaaaattctggatactaattggaggatgtatgttactgttttttctatttctttgtctctgtagaaggcttgaattaatccccgccagatcaatcaagataaaaaggacctcctgtttttcatctcatcggctgcagccacaaaaaagaagaaagcacctccaaaaaacaaacaaacaaacaaaaaaaagggaatatg

SEQ ID NO: 222 - DNA, 8967 bp, artificial
  ss2002 sequence
  misc_feature (447)..(546): n is a, c, g, or t
tgtgtgccctatgtccaagccagcagccctgctaatcatgtacccaacattgcttatcagttccgcttctgtaaccttgcttgctcagtttcttagggaggaacactgtctgcttggggatggggggaggtctgggatgtttacatgggaaaatcaagaccttgtagtgtataaaatttactgagaacaaagacctggtgctcagactctggaggtgactcctctgagcctgcactggtgctgaataaaccttgctcttccatatctctgagtgctgtttgtttccttccactgccatggtttttgtggtttctgcaacatttttggtgctttggctgggaagccaaataccaagcttgcctcttgtgctaccattgttggggaaccgggggaggccacattaactggcccactggcaagtggatagcacgcactgcccactttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaattttctcaccacatttgtctttgtctggagtcaaatgccagcttgcttgttggggttccattcttgggaccggtggaggccacagtcatgggcccagtggcaggtggatagcacgcacaggccattttgccagatccagaccctccctcaggccatgctggccttggctcacactgcttcccgaacggactcagagggagagtggaaacaggttccaagacaggacgtcggactggtgagtgccccagggacatcccaccatatggcagaaggagcgactgatcacctctcagtgacaaaagggtcattcaggtcaggatttgctcccttgggattgggaggcttgtcaattctggtgtatgtgtgagtgactggagagaatgagagcccatgctccaccatctttggactatggagccagagtgagtcctaacctgcagttctgtggcgaccctcatacggcttatagtggccctcttcagagggatcctgacgttggggtttatacagtcccacctatgctaagaggctcctgaaatatctcctccaggggagcagtcagacagacgaagtgattgttacctgaggccttgtccttgctgtttgtcacaatatcatagggtgggacttcacacaatgggtaaatcggcttctaagcccactgtcttagaatgtatggttaagaattttaagaaaggattttctagagattatggtgctaaactgagtcctgaagaactgtgtaccctctgtaccctagagtggccctcctttggtgttggctggcctccggaagggaccttagatgtgttcacagttgcagcagtatataatgttataacaggagaccctggacacccagaccaatttccgtatattgatcaatggttggaaattacctatttgaggcccccatgggttcagttctgcaccagagaccagggacagtgtagggtgctagtagcccagtccaagaagaaaaccttgtctcacaaaaaaaaaaaaaaaaggcgccacctatttttcaaggggaacctgaggactcgccccctatgccaccactttatgtgctgccagccccacctctgggagccgaaggtccccagatgccagatagcccaccaccttctgtttctcctcctccttctgcttctgaagttcctgaggcaatatcacccctgatgccagattctccagaaccaatgagcaggcacctccagtcagctcagggagcagccactccagcattgcaaatgcccttacaggaaacacggggaccacagcaagtcacccctgatgggaccatacaagaggggggatagtttttttcttacctgcccttttccactgctgatctcctcaactggaaacaccataatccctcatattctgaaaaggctcaggtgctaattgatctcttagaattcattttccagacacactgtcccacctggatagactgatggcaactcctttttattctgtttgacactgaagagctctggtgaattggaatagaagcccaaaaatagcttcaggccaatgcggggggtcaagcagacttggcaaattgggtaagggaagccttcccagaagaaaacccccactgggactatgacactgaagaagggaacataacctagagaggtaccagcaggccttctacagggggcaaagctggggctaaaaggcctactaatatagctaagaacagtgagatactacccagccaaatactatgagagactatgtgaggctttccaaatcaataccccttttgatcccgaggcccctgagaaccaaccgatgataaatgctgcctttgtgggacaagcccaatcagatgtctgtaaaaacctacagaaattagaaggatttgcaggaaagaatgctactgaactgttggaaatagccaacaaggtttttattaatcgagaccaggtggcccgctgtgatgcagaaaagaaaatgaaacaaaaagtgactcttctggtggctgccctgtcaaaaccggtgcccccacagtgggactaccccataggggacaaggcccaaggtcaggagaaaggagtcccctggaacatgaccaatgtgcttactgcaaagaaaagtgacatttggaaaaatgaatgccctaaccgtcctgagaaaaagaccaaggccccacctagccggtaccgatctgaaccattcaacaccaacctgatcggcctagctgagtctgattatgggggaccaggctctctccaactgggcccccgagagtctatggtcagaaattcagtagggggccaccccatagactttatggttgacacaggtgctgaactttctgtggttacacaacctctcagggaaagaaattaccgtccttgtggccacaggtaaccaaacccacaggctcttctgtggtcctcaatgatgtcaattaggaggccatgaagtaatacatgaatttctttacctgcctgactgcccagtccccctgaagggaagagacctgctggctaaaatgggggcacaaatttccttttctactgacagattggcccaactcaaattgacagaacccccctctcctttaatcatggctcttgctgtaaaaagggaagaggaatggcacttgtgctcttcctcttcagaaatggggaccactcccccagaactagagactaaatacccattggtttgggctgaaggaaacccaccaggactggcaaaatgccatgctcctgttttgattgatctaaaacccggagctcaaccggtaaacttacggcaatactcaattcccagagaagctcaactgggaatccaggttcacctggataggctgcttcagcacggactgttaataaaatgtcagtccccttggaacacccctttactgcctgtaaaaaaaccaggaacacaagactaccacccatttcaggacttgagatccataaatgaagcaacacattacacctgtccatccctaacccatataccctgctagggctgatcccctccactgctgagtggcttacttgcctggacttaaaagacacctttttctgcctctgggtggtgtctgccagtcagcccttatttgcttttgaatgggaaaatccacttacagggacaaaggaacagctcacctggactagactcccacaaggattcaaaaactctcctactctttttagcagcgccctagtggctgacctggctgaattccctggacaaaaactgggctgtgttttgctactgtatgttgacgacctcttactagctggcaccatggaggctcagtacctagagggaacaagagctctcctttccctactgatggaggcagggtatcgggtatcaaagaaaaaggcacaaatctgtaaaaaacaagttaagcatctgggctttaacatcatgcagggctgatgaatgctggggactgaaagaaagtaggcagtttgtgacattcctgtccctaccacctgccggaaggttcgtgagttcctaggggcagcaggattctgccggatatggatccccgggttttcagacttggccagacctctgtatgaggctctaaaaggggaagaaaaggctccccttgaatggggaccaagccaggaggcagcatttcagacaatcaaaaccaaactcactgaggctccagccttgggacttcctgatgtaaccagaggatttaacctttttgttcatgagaaaaaatggggtggctttgggagtcttaactcaagaatttgggcctttgcataggccagtggcatatctgtctaaacaaattgactcagttgcagccagatggcctccctgtctccaagcactggcagctaccaccttgttggtgagagaggctgacaagttgactctgggacaaaacctcaatgttaaagtcccacactcagttgtaaccctaatggataccaggggccaccattggctcacacatgcacgaatgactcaatatcaagggttactatgtgaaaatccatgggtaaaactggagattgtacgaactctgaacccagccacttttctgccagatgaagcggggcccccagaccataactgcttggagatactagatgaggtgttttccagcaggcctgacttgactgataaaccactccaaaatcctaacctggtttatatactgatggcagcagatttatggaggatggaaggatatgctgtggtatctgacttaaaagtggtagaagcagaggtgcttcctcaaggctggtcagcacagagagcagaattatgggccttaatcagagcactggagctcagccaagaccagcaagttaatatctatactgactcacggtatgcctttgcaactttgcatgttcacggagccttatataaagaaagaggactcctcactgctgaaggaaaagggattaaaaaccaggctgaaatcttaaagctcctagaggcagtatgggaacctaaagaagttgcagttatccactgtaaaggccaccaaaagggagacaacccagtgacaaaaggaaaccatagtgctgatgcagctgccagagaggcagcccgggaacaacagccagacaaacctaaggtctggctggtcccagaagtgccagctgtccccagatattctccagaggaaaaaaaatggataagggaggaaggaggaactaaaactaagatgggatggtgggtcacacgggaccaccgagtttatgttccagaacagctggcctacaaactagtccaccaacaacatgagctaacccacatgggcaaaactgccttagagaccctactgggccagtactatctcattgctcatcttcctgcactctgctcctctttctcccaaagatgcataacctgtttgcagaataatgcccaccaggggcccaacagaccagctggggtacaacactgtggactgtccccatttgaggatatggaagtggacttcactgaggtcacccctagtaaggggtacaaatatttactagtttttatctgtactttttcaggatgggtagaagccttccctacccgaactgaaaaggcaagggaagtaaccaagacactcctgagagacattattcccagatatggaagcctctgaccatcaggtcagataacggactggcatttgtggccaaaacagtacaacaggtagcaaaagatttacagatctgatggaaactacattctgcttatcaccgtcaaagttcagggaaagtagaacgcatgaactggacccttaaatggacactggcaaagttatgtcaggaaactggcttgccctgggtagacatgtcaccagtggccctcctaaaagtgagatgttcaccccaagcaggaataggattctcaccattcgaaatcttatatgggaggccacctccactaatcagtttaaaagaaaacaccagggagttgggagacttggaattacttaaacaattacaaggactggggctcactatttctcagatatataaatgggtcagagacaggatacctgtgtccttaggtacaacagtacacccccacaagcagggggaccaggtgtggataaaggactggaaaaaaggagcctttgaggctggtatggaagggcccctatactgtaattctaaccacccccactgctcttaaagtaacaggaatagatgcttggacccatcattccagagttaaactggctggcccagttgacaaccatggagagtgggagactgcccccgatcaggagagacctctttgcctgacaatacagagaaggagaggacgatctcaaagccctgctctgaccacaccggaagctgtcagtcaacgcacggctgaagcttgagtaatctgctgcctggtaaaataaactgccttacctactttccacaagagactttcttactgttatatactgttatcttatatccaacatgtatgtttgctgcctgttgctattaatctggtcccctttggttctgccaggatccatttcctgtgacccatgcattcgagtgacgcgatcagatcaaggggttacatggactttgctttactccactcatttctcccgttccggagaaattcatggaagttgtactcacaacaggaccacttattctatatgtcaacagggggaccattatacttgctttgagccacgatattcaccaactgaggaatggttagaggtccggtgctctcataaatcagggcagctaattaatcggacccaaattaccaaccccaagttgccagtctcaatactttttgatgcctgtgaagctatgagtgggtcatggacttctactagaccatgtggaagcccatcatgggaaagagaatataggctccagcataaatatatgtgctgggggaccacctggagcggttgccaggaatgcacttactggagttgcgtagcctgggcaacctggaataagggaaacaaaacagctgtctttcaaaagggtacagcccctccagactgtcacactaaagcttgtaacccagttaatttcactattttcaattccagtgagcccaaatggaaggagggtttcaaaataagcattcacattgatggaagatgccttgacactggagctgtgctgcatttccagagaatcacgtttgtgctccaagctgcctctcacagggtctttcattccttttatgaagagataagaaacaccccacctcccattccggccacaactaagaactcgttcttagccctggcagaaactattgcacaaactctcaaggtctcctcttgttatgtatgcaggggaacaaacacaggagaccactggccttggtaagccagagaactgaacccattagagcctcataataagactgcatacccccaactcaccaatggggtatggctcctcagaactgctattatagggagaaattgtcttgcaaggcagggaggatggtttaatgtttcagttggaagcctaacatgtttaggcctaaggtattataatctgactgcccaaaaaactcaatggtggtcatcctccaacctctcagagcccaagcctaatcccctgtctaactttccccacctccgacaagcatgggaagatatcagtgctaatatccaatggagggcaccaaagggattatattggttttgtgggaaaatggcctattcttatactcccccctagttgggctggggcatgtgtactgggaacaatcagaccttccttcttcctgctcccactatcactaagggagcaactgggagttcctatatatagggcacagggtgcccagagagaccggagggctctccaaattggagactggaaagatgatgaatggcccccagaacggataattcaatattatgggcctgccacttgggcagaggatggctcttggggatatcgcacccctatctatatgctgaactgcatcatcagactacaggcagttttggaacttataacaaatgacactgcaagggccttgactatattggcccaacaacaaactaaaatgcacagtgaaatctaccaaaatcacttagccttggattatttacttgcttctgaaggagatgcttgtggaaaatttaacttaagtaattgatgtctacaaatagacaacactgtaaaggtgatagaagaaattgctgatgtgatagaagaaaggtgatagaagaaattgcccatgtgcccgtacaaacttggaaaggatgggatgcagacagtctctttggtaaatggttctcttggttgggaggaattaagacaatggtcggaataatcatggttatactcgcagggggcctacttattccctgccttgaacctctcctgataaatattataaaaggttttataagaaccatggttgaaagaaaaacagcctcccacctgctacttatcagaggctaccaaaggattatgacttctgatgatctctgaagggtgcagatgcaccctgaacatcaagaggagggaatgaaatagagttttaactaaagaactaccccccccttggctaagaaggcagctgcaaacctttccagctatgctcatcactataccacccttcttgtaataatgtaacaactgtgtgccctatgtccaagccagcagccctgctaatcatgtacccaacattgcttatcagttccacttctgtaaccttgcttgctcagtttcttagggaggaacactgtctgcttggggatggggggaggtctgggatgcttacatgggaaaatcaagaccttgtagtgtataaacattactgagaacaaagacctggtgctcagactctggaggtgactcctctgagcctgcactggtgctgaataaactttgcttttccatatctctgagtgctgtttgtctccttccactgccacggtttttgtggtttctgca

SEQ ID NO: 223 - DNA, 7744 bp, artificial
  ss2009 sequence
tggtgcgttggccgggaaacccgcgactacccctcacacccgagaaccgacttggaggtaaagggatcccctttggaacgtgtgagtgtgtgtgtcggctggcgtctctgttctgagtgtctgttttcggtgatgcgcgctttcggtttgcagctgtcctctcagaccgtaaggactgggggactgtgatcagcagacgtactaggaggatcacaggctgccaccctgggggacgccccgggaggtggggagagccagggacgcctggtggtctccttctgtcggtcagaggaccgagttctgttgttgaagcgaaagcttccccctccgcggccgtccaactcttttgcctgcctgtggaagacgcggacgggtcgcgtgtgtctggatctgttggtttctgttttgtgtgtctttgtcttgtgcgtccttgtctacagttttaatatgggacagatggtgacgacccctcttagtttgactctcaaccattggactgaagttaaatccagggctcataatttgtcagttcaggttaagaagggaccttggcagactttctgtgtctctgaatggccgacattcgatgttggatggccatcagaggggacctttaattctgagattatcctggctgttaaagcaattatttttcagactggacccggctctcatcccgatcaggagccctatatccttacgtgacaagatttggcagaggatcctccgccatgggttaaaccatggctgaataagccaagaaagccaggtccccgaattctggctcttggagagaaaaacaaacactcggctgaaaaagtcaagccctctcctcatatctaccccgagattgaggagccgccggcttggccggaaccccaatctgttcccccacccccttatccggcacagggtgctgcgaggggaccctctgcccctcctggagctccggcggtggagggacctgctgcagggactcggagccggaggggcgccaccccggagcggacagacgagatcgcgacattaccgctgcgcacgtacggccctcccataccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgaaattgacatgggatttcccttgactcgccccggttgggactacaacacggctgaaggtagggagagcttgaaaatctatcgccaggctctggtggcgggtctccggggcgcctcaagacggcccactaacttggctaaggtaagagaggtgatgcagggaccgaatgaacctccctcagtttttcttgagaggctcatggaagccttcaggcggttcaccccttttgatcctaccttggaggcccagaaagcctcagtggccctggccttcataggacagtcagccctggatatcagaaagaagcttcagagactggaagggttacaggaggctgagttacgtgatctagtgaaggaggcagagaaagtgtattacaaaagggagacagaagaagaaagggaacaaagaaaagaaagaaaaagagaggaaagggaggaaagacgtaataaacggcaagagaagaatttgactaagatcttggctgcagtggttgaagggaaaagcaataggaaaagagagagagattttaggaaaattaggtcaggccctagacagtcagggaacctgggcaataggaccccactcgacaaggaccaatgtgcatattgtaaagaaaaaggacactgggcaagggactgccccaagaagggaaacaaaggactgaagatcttagctctggaagaagataaagactagggaagacggggttcggaccccctccccgagcccagggtaactttaaaggtggaggggcaaccagttgagtttctggttgataccggagcgaaacattcagtgctactacagccattaggaaaactaaaagataaaaaatcctgggtgatgggtgccacagggcaacaacagtatccatggactacccgaagaacagttgacttgggagtgggacgggtaacccactcgtttctggtcatacctgagtgcccagcacccctcttaggtagagacttactgaccaagatgggagcacaaatttcttttgaacaagggaaaccagaagtgtctgcaaataacaaacctatcactgtgttgaccctccaattagatgacgaatatcgactatattctcccctagtaaagcctgatcaaaatatacaattctggttggaacagtttccccaagcctgggcagaaaccgcagggatgggtttgacaaagcaagttcccccacaggttattcaactgaaggccagtgctacaccagtgtcagtcagacagtaccccttgagtaaagaagctcgagaaggaattcggccgcatgttcaaagattaatccaacagggcatcctagttcctgtccaatctccctggaatactcccctgctaccggttagaaagcctgggactaatgactatcgaccagtacaggacttgagagaggtcaataaacgggtgcaggatatacacccaacagtcccgaacccttataacctcttgtgtgctctcccaccccaacggagctggtatacagtattggacttaaaggatgccttcttctgcctgagactacatcccactagccaaccactttttgccttcgaatggagagatccaggtgcgggaagaaccgggcagctcacttggacccgactgccccaagggttcaaaaactccccgaccatctttgacgaagccctacacagagacctggccaacttcaggatccaacacccccaggtgaccctcctccagtacgtggatgacctgcttctggcgggagccaccaaacaggactgcttagaaggtacgaaggcactactgctggaattgtctgacctaggctacagagcctccgctaagaaggcccagatttgcaggagagaggtaacatacttggggtacagtttgcggggcgggcagcgatggctgacggaggcacggaagagaactgtagtccagataccggccccaaccacagccaaacaagtaagagagtttttgggaacagctggattttgcagactgtggatcccggggtttgcgaccttagcagccccactctacccactaaccaaagaaaaaactttaatcaaagaaatcaaagaagatgtaaagaaatggaaagatattccatgttcctggattgggaaaatcaatattgtaaaaatggccatactacccaaagcaatctacagattcaatgcaatccctatcaaattacccatgacattgttcacacaactagaacaaacaatccaaacatttatatggaaccacaaaagacccagaatcgccaaagcaatcctgagaaacaaaaaccaagcaggaggcataactctcccagacttcaagaaatgctacaaagccacagtcatcaaaacagtgtggtactggtatcaaaacagacagacagaccaatggaacagaatagagaacccggaaataaaccctgacacctatggtcaattaatccttgccttgtttctgatcagaagaggaaagtattcagtctttcaccatcaagtatgatgctagctgggtttcaccatcaagtatgatgtagatattcttcatcaaattgagaacattctcctctatttatagttgtatgagagctgtaatcaggaatgggcattgagttttgctagatgtgttttctgtatcaactgatgtgactatgcaatttttctgtttttcctgttaatattctgaattttattgattgatgttcaaattttgaactaatcttgcctccctggaataaaccccacttggtcaagttatataacttttaaaaacattgctatatttggagttcccattgtggcacagtggaaacaaatccaagtagtatcatgaggatgcaggttcgatcactggccttgcttagtgggtcagggatcctgtgtttctgtggctgtggtgtaggccggcagctatagctcctattcagcccctagcctgggaacttccatatgccatgggtacagccctaaggaaaaaaaaaaaaggatttgctgagttttatttgctaatattttgttaaagatgttgtttctttagtgtgaagggtattattttatacttttgtttttatactttcattgtcttgttttggtatcaaagtaatagtagccttgtaaaatgagttgagtatgaatcttctattttcaggaagaaattgtatagaatttgatgttgatttcttaaaagtttggtagaactctccagtaaaaacatcttggcctggagatttcttgtggggaagtttttaatcacaaattcatttttgatagttttggggctaatcaaattatctatttcatattgtgtgtgttgttgttgtttgtgccttgctacaaattggtccatttcatctaagttgtcaaacttatgagtttaaaattgttcatggtattcccttttcatctttttgattagttcagggtttgtgataataccccatatttcattcctgatatgagatgatttgtgctttttccttttaatcatcagtcttgccagaggttagtcaattttattaatctttacaaagaaccacctttcctttccattatttttgtctgttttttttttctatttttaattttattgttttctgcttattttttatttccttccatctgcttgcttttgtgtttagttctctattctttttctaatttcttatggtgggagtttagatagttgatttgatttttttctcttttctaatataagcatttagtgctaaaaagttctctcatagcacggttttagctgcattatacagattttgatgtgttgtattttcatttttatccagttcaatgtattatatacatgcataacctatcatcatcatcaactggggtggacattttaccattttgagtaaagtgtagacaccctacctccttttatgtccctcagtatgcccctgtttatcatatagctttcttttttccccctttttggctaccagggaacttcctgtcaaacataatataggaaattcaagaggaaaatgaaaggccatgtatttacctatatttttactcttccagtcattccaatacatgtttttttttattatttcttttacatttcaagaacttccttaagccattcttttagtgtgagcctatgagcagtaaattctcagtttttcttcatctgagaattcctttctttaccctgaatgcccgctagataattttgctagatatagaactctgggttgccagttcttttctttcagctcttgaaaatactgtgctacttcctcttggactccatggtttctgatgagaaactcactgccatttgtgttgttttatcccctaattaatgtgtcttttctctctcgttgcttttaagatttttttctttgtctttagttctcacaagtttgatttgatgtgtcttggtgtggctttctttgggtttatcctttttaggatttactcagcttactgaatctgtcagtttatgtctttttgccaaatttggggggataggggaccattaatttttttagtagcttttcagcctcatctgcattctccttttcttccatgacatggatccagtgacatgaatgttagctcttctactctagtcccacaggtccctatgcctctcttcacattttcttcaatatattttatctccattgtttagattgaataatttctgttgttctgtcttcaagttcaattatttattgtgtctctttcattatttaacctcatccattgaatttttcatttcaatgattatatttttccattcaaaaatttccatttggtcctttttaatatgtatttctttgctaagactgtattttgggggaatttttcttcttctttttttttgatgctctatttttttgtctccccaatacattatttttttcctactgtatagtatggcgatccagttgcacatacatgtatacattcttttttctcgcattatcatgctccatcataagtgattagacatagttcccagtgctacacagaaggatctcattgctaatcaatttcaaaggcaatagtctgcatctattaaccccagactccaaatccatcccactctctccccctcccccttggcaaccacaagtctattctccaagtccttgatttttttttctgtggaaaggttcatttgtgccatatattagattccagatataagtgattggagtaggaagatgtggtatataaacacaatataatatgactcagccataaaaaagaacaaaataataccatttgcagcaacatggatggaactagagactctcatcctgagtgaagttaagtctgaaagagtaagactgatttttaatttgttttaaatatgtttataattccttgttgagtgatttttatgatgactgctttaaaattattgttaagtaaatttaatacctgtgttaactttttttatgcatctattgattttcttttctcattcaagttgaaattttcctggttcttggtatatgataggtgatttttaaaattgaaatctggacatttcatatatttttcccatgtgactctgtatttatttaaattttcttttctttttcttttttttttttttcttcttttaaagcaggagtcctctaacattgcactagcagaggaagaaagataccatttcttactgccagggtggggtaaaatctaggttgcccattctacctcctttgagaccccaagttgaggcatgccacattacagatagacagataatagggttttagtttccccactagacctccactgacagtaggagtggggaaggactcatttactgtgaggcaggaataaaagtcctggctccctactcggccttctctgataccagcccagtcatgggggacagggcaggattaggacaccttgttatggtctggtaagagtggaagtctaggttccttactcagcctttgctgacataagtaggtgtggagccacagttttttttctgtagtgttatgtcggagtagagtggttattgtgtaaaagttttctgtcttgctatattacccgtttttctgatccattggataaaagagagctggctattgttgaggctgtgttttttaaattttatgttgtggttgtgcccattggggtttctgtttgctggtttccctagcacccagggaactcaccaccatattgttccgtgggtcttaagttcttttctggcctgcggtcttctctccacttttcagaaccttcttatatttgttttacataaaacaaccagagtttttagctataccaatcaggagaaggatgtctacttctctcatcaggaagaagtccccctttgttattatgttttcctcccatttaactaagtccatagggatagtatgaatctgctctaattggcttttacaaagggaaagaggaaaatgaaggaaaat

SEQ ID NO: 224 - DNA, 9059 bp, artificial
  ss2028 sequence
tgtaagggaaaatggcccgaccaaaaggtcaaaaggagacgccccagccatgatgactaagcaaaatccagccaaactgcccctaaccaatcaactacctctaaccacccctcccctacacatttgcttctgtaaaactcactcctacgtctattactttgccagttctcactccagtccaccaagcatggacccggaagaactaacacataaaagccttgtgaaacccctctttggcgctcagacttcagagagctatctcctctgagcccgccggcgtaataaacctgagttctccaactctccgagtgctcgcttggtttctcgccaggtgaaagagctgctggagctggtacactgcggctacagagctgctggagctggtacactgtggccacagggccgctggagctgatacactccggccttgggctgctggcagtcgccataacatttctggaggccccagcgagattccaaccgttctggccccttgagccactggaacgaggcaaggccacccaggagttggggagcctcgaaccaaacgaggcggcgcaccacccgacggtattccaggtcctccttcgtgagcagcattcctgactcccgggcgatcgaaccccgaccggattctgaggagaggtggaccaactcaccaggaactcgtccggacaacgtaagacctcggggtcaaccccagtcaggtcctgccccaatgggcagaagaggggactgatcaccccctgagggagactctcccggtcggaagctgtgcctgaccagagcagtagtcctagtgctccagattggaagcagaggaacctcttgcttgggtggagcaactgttgggcgtagccgattgaaagttgtgcttgatcgagctactagttagggactcccagggagtgggaggcattgtgataacctctgagtgtgtgtgagagtgaatgagtggcctgattcgcttgcgcttcaggttcaagtttgtggctacggagtccgagtgggtcctaaactgcagttccgcggtgacctcatatggcttatggctgcagcggactctgagggttctcttccctccctgtgagtccaatccaagttcggggcttatacgaaccagccaattgctaagaggcacctaaactcccgataggggggcggtcaggcggacatctgaatggccaccttctaagaagggggcaccctcccttgtttcgtctgcgacaccggcacagggtggccacatagggtgggacctaacccagaagcccacgagccagagacccctgtgcgtccaccattttgggccataaattcctccgaggagataatctaactcaactttgcccctgggcctccaggaactcccattccagactctagaccagctacaggattacccaatttgtcagttcatgtaggcccaggatctgagtcagggagacaagcccatcatccccgtctcagttcaggatataggtaggattgggtacaaggtcccctgtcctttgcccaaaacgttagaacttgtctgagaatgcctctctgagacccggggtccagataggtcagagacccttgcaacgaagcaggtgttttttccggctatagagtgagctgagtgggagctgttttgatttcaggagtggcagaggcaacgctacaggggatactgttcacaaggacgaaagaggtgtcataaaaaccagatcataggtgaaatccacagaaaagcatcatgggctcgtcctaatcaaaacccacaatcctagactgcatggtcaaaaactttaaaaagggtttctcaggagactatgggactaaaattactccaggaaagctccgcaagttgtgcgaacttgaatggccagcattcaatgtgggttggccttcagagggcactcttgatttattgaaggtccaagcagtctatcaagtagtcactgggacaccgggacatcctgatcagttcccatatattgactcttggctccagattgctcaggtcttgcccccttgggtccggttctgcactaatgggaagggacagagtaggatttttgtggtccaaaagtctggaaggaaaaaaagtgagactactaagccaatcctccaaggagaatcaggggacgaacccctgatgcccccgccatatgtatcaacagctcttccaccttcagctcagcctccatccaatcaccttccagaaagcccgcccccatctgtgtccccaccacttcaaccactgcggactccgagcccggagccagtaggcagacggctccgctctgctcagcaatctacccagccagctgcagctctccaagtgcccttgtgagaaattcagggtccccaacaattgaatgaagatggttctgtatagccaggtcggcccatcctctactaccaaccgttcagcacagccgatctcttaaattggaaacaccacaccccagcatattctgagaagctgcaggccatgattaacctcttggaatcggtcttccaaacccatcagccgacctgggatgatatccgccacctcctcctaaccctctttaacactgaggaaaggagacgcattttggctgaggccaggaagtggctccaaggacaggcccctgctggcaccgttgatgtagaaggatgggcacaaaatgcagtccctgaagataggccagagagggatttcaacacaccagaaggctggggtgcactgcgccattactgcgatgccatcctacaagggctcagagctggggccaagaagccaaccaatatgtccaagactaccatggtgattcagaaggtagatgagccgctgggggacttctatgagagactgtgtgaggctttccgaacttacactccttttgatccagaagcccccaaaaatctacggatggtcaatgctgcctttgtggctcaatcgtacacagatattcgacgtaagctccagaagttagaagggtttgctggaatgaacacaacccagctactagaggtggccaataaggtttttgtgaatcgagaccaggaggcccaatgagaggctgataaacggatgaaatagaaggcatccctgctagcagcagcactagggaaaccggaccccagcaggcagcctgcaccaccacgcaaaggagggatgagaagaagaccaccactacgacaagatcaatgcgcatactgcaaggagattggtcactggaagaatgagtgcccacagcggaaggaaacaagagaccaactggggaaaaggggtccatcggacaagaggaagtacaggcccgagccagttgcccatgatctcgttggtctagccggaatagactctgattagggaagaccaggctccctgctcctgggcccctgggagcccacggtggaggtgatggtggggggccaacctgtaacatttatggtggacacaggggcagagcattcagtggtggccaccctctcaagaagaaaagtgactattgttggggctacgggaacacaaacaaatcgtccattttgccagcctcggacctgtcaacttggaggccatctggtgactcatgagttcttgtatgtgccagaatgtcccattcccttattgggaagagatctcctgactaaactaggagcccaaagaacattcactcctggagggccagctagcctggccttaaaagataggggaacctttctaatggcagttacagtacccagagaggatgaatggcgattctattgctcagagaagagctacacgaacccagaaagcctactagaagagttccctaaggtatgggcagagaaaggccccccgggatggctaagaaccatgcacctatcatagtagacctgaaagctgggagtaccccaatcagacagagacagtatcctgtcccccgggaagcacgtctggggatccagagtcacatacaacgactccgagatgctggaatattgagagagtgtcaatcatcgtggaacacaccactactgccagtcaggaagtccgaaggaaaagattactggccggtccaggatctgcaggcagtcaacaatgcagtcgtcacgatacacccagtagtgccaaatccctacactcctcagtctcctgcctgctcaggccagctggttcacctgcctcgacctcaaggatgctttcttctgcctccagctggcaccggtcagccagccattgtttgcttttgagtgggaggacccgctcacagggagaaaaacacaattaacatggaccagactaccacaagggttcaaaaattcaccaaccctgtttggagaagcgttggccactgatcttgctgcttttcccagagagagtctgaactgtaccttgcttcagtacgtggatgacttacttttagctagccccactcgggaagactgctgggcaggcacgaaagccttactgactctgctctctgagacgggttacaaggtgtcatggaagaaggcccaaatttgcaagcagaaggtaaagtaccttggattcctcatctcaaagggacatagggcccttgggcctgagaggaaacaaatgatttgttcaatacctcggcccaatacaaaggggttcgagagttcctgggagctgcagggttttgccgaatctggataccaggattttcaggcatagcaaaaccactgtatgaggccattgcaggatctgggaaggagcctttgaagtggagaccagatcaggaaggagccttcaaggaaataaagggactgctaattagtgccccagcgctaggattaccagatgtgactcggaacttcaacctctttgttcatgaaaagaaccatacagcgctgggtgtcctcacacagactgttggactatggtagcggccagtggcttacttgtccaagcgtctagatccagtggcagcaggatggccaccatgtctccgagccctggcagccacagtagtcctaatcagagaagcagacaagctcaccctgggacaaaatataaacgtgaaagttcctcatgcagtaacagccttaatgagcagccaaggtcataagtggctgacccacacccggatgacacactatcaagggctgctctgcgaaaaccctcgagtacatctcgagacggtgtggacactgaatccggccactttcctgcctactgaggtgggcccgcctgaccatgactgtgaagagaccatagatgaagtttattcgagtcggccagacctaatggacgttcctttctcagacccagagcttgagctttatacagatggaagcagcttcgtccaaggaggacaacgcaaagcaggatatgctgtaactacaacagagaaggtaataaaggctgaagctctcccacagggctggtcggcacaatgggctgaactgtgggcattagtccaggcactgagatatgctgaagggaaaagagtcaacatctacacagactccaagtatgcatttgccacgttacacgttcatggggccatctataaggaaagaggactgctcacagcaagagggaaagagataaagaacaaagaagaaatactccagcttttggaggaagtgtggaagtcctcccaggtagcagtcatccactgcaaaggccatcagatggggagtgaccccatcagtaaaggaaatcgactggctgatcaggcagctagggaggctgccagctgatgggttcctgaaacagaaaccctctctaggatcctgttagcgccagaaatgcctcccactcccaattatactaaagaagaggatcaatgggccctgtcagaaggagggaaaaaggagggggaaggctggtggaggttaccggatcagagacttttcatccccagaacggcagcagcccagttagtaatacagtaccatgaaatgactcatctgggaaaaactgctttagaaagcctgctaaattgttattactttatagataagctccccaccctatgcgcccagatcagcctccgatgtgtggtctgtgctcggaacaatgccagtcaaaagcctaggcccagtcctggagtacaagtggtagggacaatgccctttgaggacctggaagttgacttcactgaagtcaaaccctgccagagctatcgatatctactagtgctagtatgcacatattcagggtgggtagaagccttccccacatgaacagaacgagcctgggaagtggctaaggctttgctgagagaaataatccccagatatgggttacccctcacaattggatctgataatgggcctgcttttgtgtcggaagtaacccagatcttgactaaaactctgggaattaaatggaaactccatacagcttataggccacaaagctcaggaaaagtcgagcgcatgaactggacccttaaaaccactctagccaagttgtgtcaggagactcaattaccctgggtagatgttctgcccttagccttactccgaacccgatgcacacccagatccacgggctacaccccatttgaaaccctgtatggaaggcccccacctgtaatagggaggttaaagggagatcccagacagatagccgacatggagatatcccgatacctccaggccatagggaaagtcctccattgcattaccagagagactctggagagggcccctatccccttaggcaactggatccatcctcatcaacctggagacttggtatgggttaaggactggaagaaggaaccactccagccagtttggacaggtccttacatggttatattggcaaccccaactgctgtcaaagttgcaggtattgtcccgtggatccatcacaccagaataaagaaggctgctcctgccactaacacagacacctgaaaagctgtccggcatcctgataaccccctcaagatcaagttccagagacattcggcaccagaggacgacaggccctgctctggccacacccggaagctggccagtctacgcacggcagaagcttgaggaatctgcagccctgaaccagccacatactggaagttggctggtttgtacaagtggaggccagaggatctccatgcaaacttgaactgaactcatgctctggtggggaatattggtaactgaaattgccatgtttgggtaagggttatatgtgatatccccttcagaatggggacagggagcccagcttctcatctgtgtgatgtatctcctgactatcagcatactaggatcccaattcatactaggtcagtgaaaaggattaagggggtcatagttttgttaacagttgccctgctgctcactccaggggtgacggattgggatgatgatctatgggatgggacaggattaacagatgataggccacccggaaaccactacccggctggctacaatccagggctagggggaataggtttcgagtttgaaaaatcacatgaggggcctccactgcctccactgctccctcccccccataaagctacccaagctaaaacccaaacctctaagtcatggtcttgacctgagccaaatgctgaatgccacgcaccacctgttaaatacaacaaaccctaaattggcaagggactgctggctctgtttacccatccaaaaacctcaacttattgccataccgatgtgtcatcaataccaccaagggaaaccaaagccagtttgatccaacacaagaacctagactggtaggtgtgcacatgcctctcaaggccccatggtgtattcaaagtcttgggaaagtggttcaggtgggttacctgacagaatgtgataatgttacaaatattgagaacttagacccctctttgatcaatgggacttggtgtagaccccagaccagtcttttctttgtgagtgggaattgtgcttaccagtgcctccctgctaattggaggtacctgcacattagcctttgtcactcctcaaataggtattgttcctggaaatcagtctcttatggtgcccatagaggcacatggaagaaccaagagagcaatacaaattatccccttattagttgggttgggaatttcagcagggataggagcaggagtgggaggaatagcatcctccactgcttattatcatcaattgtctaaagagttcacagatgacatggaacaagtagccacttccctagtagccttacaggatcaagtagactcttgggcagaagtggcccttcaaaacaggagagcactggacttactcacttctgagaaagggggactttgcctgttcctcaacgaagaatgctgtttttacacaaacagatctgggatagtcagaaatatggcccaacaactaaaggaatgtatagcaaagagaagggaagaattagataactcttggttaaattggggcaactactggagttgggtggcatggcttatgcctctggctgggcccctcctcatgctcttcatggctgtcatatttggcccctgtatcctgaactgtcttgtcaagttggtctcctcacgcctagaatctataaagctataaacagtggtgatgtctgggccacacttatatcagcccctgggccaagaagaccaagaaggttgatgcttgcttcaaaaatgtgaaagaaagcatcaagaggggggaatgtaagggaaaatgacccgaccaaaaggtcaaaaggagagaccccagccatgatgactaagcaaaatccagccaaactgcccctaaccaatcaactacctctaaccacccctcccctacacatttgcttctgtaaaactcactcctacgtctattactttgccagttctcactccagtccaccaagcatggacccggaagaactaacacataaaagccttgtgaaacccctctttggcgctcagacttcagagagctatctcctctgagcccgccggcgtaataaacctgagttctccaactctccgagtgctcgcttggtttctcgccgggtgaaagagctgctggagctggtacactgtggccacagagccgctggaactggtacactgtggccacagagccgctggagctgatacactccggccttgggctgctggcagccgcca

SEQ ID NO: 225 - DNA, 9059 bp, artificial; identical to SEQ ID NO: 224
  ss2030 sequence

SEQ ID NO: 226 - DNA, 8182 bp, artificial
  ss2033 sequence
tggtaaatgacttaagtttaagagcaaagacctaaaggcataagtgacttaagcttaagaactgttatgtgcctagaggtcagagtaagagcttaaccctttaccacctaagtggctttctaaacaaaccctgtatcatccacccatagccactcctcacttaatctcacaataaaagcagtgtggtttcttgaggcagtgctcttggtccctgagaccttgagtcccccggctcccacctttacttaagataaatgtctctgtgtcttgttttatgttaactatttttccttaagttccacagcacccgttcttccccatcctgctgagctggccccggcaagtggcgcccaacgtggggcaggctcacaaacaggcaggcacgaggaacgaaggaccacgactacagcagaaattttattctctggaagtgctgtggagccctgagaagaagggaggaattttgtgtggccaagctaaagaaatcctgcagataagttccctctctcaggtatttacggggtaaaatgggaaactataatccttacatttgtgtgtttggacaactccttaaaaaggggggtgcaaaaacaagtgaaagtaagcttttgaaactttttcagactattgagagacattgtgattggctttttacatcagaaacattatatttaaagatatgggaaatggtaggaatggaacttaggatattgcaggatgagggcattcgaattcctgagtccatttggagtacttggaacttaattaaatcagttttggaacttccagagaccacagaggacttagaggaagaaggggagtttacacctttgttggaagaatctaaatatgctgtccctgaacaaaattatcatagagaatatctggctcctgagccttcggctccaattgttgattctgatattcctcaatcgcctcctattaggagtaaggtgacgcggactcgtcaagcctctacttccagggttgtaaagaaagtgagcgctatccctgaacaccacctatcatccattcaacagggaattttacaggctcaaagggaaggcgatttggatgccatacacttagcctttccagtaactgtcagggagacagtggctccaggcattgatcccgccaaccctgatggagtttatgagttcattcatgagccctttccttttaaaattcttaaagaattaaaacaggccgttcaaaactatggtgttaattctccctttacaaaaggaatcgtgcagggagtagctaaaggaaatcgtatgattcctgctgattggcatagcttaacccgtgctgtgctatcacctagtgaatatttacaatttaagtcttggtggcaagatcatgcccaaattactgctaatcgtaatcaggttcgaaatcttccaattacaatggaacaattgttagggattggtccttggagtaatcttcaagatcaattaagaatgaatgatttggctattgaacagattagacaatgttgcttaacggcatgggataaaattgaatctacgggtcaaataaatatttcttttcaaaagatcctacaaggccctaaggaaccttatactgaatttctagcttgtttacaagaggcattaaaacggcaagttactaactctgaggtgtctgatactatttttcaattgttagcatatgaaaacgcaaacactgattgcaaaaaggccataggatttttaaaaggaaaagctaacgtagctgaatatattaaagcatgtcagggagtggggacggagtcctttaaatcctcaatgctagcccaagcaatggctaatttaaaagttaaagacaaattttcagaaaaatgttttaattgtggtaagacaggacatattaaaaaacaatgtcgcgctcttccacgagcccaacctttctttcacggagcttcagcaccttctagtaacaataataaacagccccgactatgtccaagatgtaataaaggaaatcactgggctaaccagtgccggtccatctttcataaagatggaacccccttgttgggaaactaccctcggggcaagcttccagccccatcaaccaaggaagcattccccattcagaacaagagccagactccctggaactatgctctgcaccagagttcgacatcacagtagatctccctagtttacaggatttaattctccttcctagcgaaactcctacttctattacaaccaaattggaaaatccattaccatcagatacaataggattgataataggaagggcagagctaacagaacaaggaattcgagttcataccaggatattggatagtaacggggataataaagtacaagtgatggtttccactgcgattccttggaaaattaaaaaaggggatcggattgctcaaatcttaattttacctagagtccagaagaaaaaagacaggaataattttagacagaagagattcaataccacaggaggggcaggagtgtttttatcagaaaaggtcctagaggaacgacccacttgtcaagttatcataaatgggaagtcttttagaggattgattgatactggtgctgatgtttcaatcattagccatttacattggccagacacctggcctcttcagccagctgatattgaagtcactgggttaggaaaagcagagggtctcaaaaagagtgcccaatggcttaattgtgaaggaccagatgggcagccagctagattgaaatcttatgttgctcaactccctatcaatctatgggggagtgatttattacaacagtggcatgcagaaatttacttaccaccagtagatcaatatagtcatcaaagccaaaaaatgttgcagaaacagggttacattcccggattgggattaggaagacatcatcaggggagagtggaacctattgaatctgagattaaaatggacaaatctggtttgggatatcggccttttcattagcggccactgcttgtaaaaataattatgtttctcctgaacctattcgactgaaatggactacagaaaaaccagtttgggttgagcagtggcctctttcttcagaaaaattaaaggttttaagtgatctggtccaagaacaatcagagaagggccatatagaagaatcctttagtccctggaattcaccagtgtttgttatacagaaaaaatcaggaaaatggagattgttaacagacttaagaggagtaaatgctgtaattcagcctatgggtgcccttcaaccaggcctcccatctcctagtatgataccagctaactggttgttaattatcttggacctaaaagactgctttttcacaattcctttacacccagaagataaggaaaaatttgctttttcagtcccagtggtaaacaatatagcccctagaaagcgttatcaatggaaggtccttcctcaaggtatgttaaacagccctaccttgtgtcagtattatgtggcttcagttgttgagccagtcggaagacaatttcctaaaatgctatattgttcactatatggatgatatactttgtgctgcaccctctcaggagcagctgactgaggttttccaatgtttacaaacctgtctaaaaggagcaggattggttattgctcctgaaaagattcaaatgaaaagtccgtatcaatatttgggaactgtggttgaacgtaccactgttcaccctcaaaaggtagaattgagaagagatcaaatttctacattaaatgatttacaaaaattgttaggagacattaattggctccgaccttatttggggattcctacatatgaattgtcaaatcttttctccttgcttagaggagattctaaattaaacagcccccactctctaactgcagaagcggaagaggaactaaaaaagattgaaagtaaaatacaaaactcccaactaagtcgggtcaatctaaaacaacccattcagttagtaattataccttctcctcattctcccacgggaatattaatgcaattagaaaatattctcaaatggctttttcttcccagtaatgtcacaaagtctttgtctccgtacctggacttgatggcacaacttattctaaaaggtcgcactcgctgtgtacaaatgtccggaaaagatttgaatcatgtaattgtcagtttaactattaaggaaatccaaaattgttttcaaaaccatataggttggcaaattgcctttgcagattacgtaggatcaatagataatcactatccaaaaaaccctgttttacaattcataaagcgtactcaatggattctgccaaaaaaggtgaaggagtcacccatcattgacgcccctgtgatctttactgatgggactagtaaagggaaggccggatatgtggctaatcaatttaaaattataagaacacctggcctttcagcccaacaggctgaactaactgctgtaatccatgccttgagggattatcctgagcctatcaatattctttctgatccagcatatgtagttcatgctgccaaaatgattgaagctgctaccattaaacaaaatttacctgtcttgttatttgacttgtttacaaaattacaaactgttgtaagggaaagaagatatccattttatattactcatatcagagcacatactaacctacctgggcctctagttgcaggaaataaagaaattgactgcttggtgacacctgtgttacaagaagctcaacattttcatgatttaacacatgtaaatgttcgaggccttaaaaaaagatttggaataacatgggctaaagctaagacaattgttcgtcaatgtcctgcatgtcaaattattaacaatccttctcaatctgagcctggagttaaccctagggggcttgtcccaaatgctctctggcaaatggatgttactcattattcatcttttggaaaaattgtcatttattcatgtatgtattgatacttactctaaatttatttgggctactgcgcagtctggtgaatctgctaaacatgttattcgtcatttgtatgcctgttttgcagtcatgggcctgccacaagcaattaaaactgataatggcccagcttatatcagttctcaacttaaaacattcctagatacatggcatattgctcactctactggtctcccttacaacccccaaggacaggctattgtggaacgagccaatttatatgtaaaacaggctcttcaaaaacaaaaagggggagacacagaaatagttaagtcgcaacaaacacttttaaacaaaaccttattcactttaaattttttaaacttggcctctgatgaaaaaacagctgcagagagacatttttatacagaacaaaataagattaactttcctcatgctgaacagcccttgatttggtggcaggatccactaacaaacttctggtctccaggaaaacttattacgtggggtaggggatatgcttgtatttcaccaggtcatggattacaacctgtttggattccatcaaggagaatcaaaccatatcatgagcaagcttgtgaagcatcccttgactccagaccccagaaggaggatgatgagggctcatcttcctcatcttcccacttgaggtcagatcaaacatctaacccgagaagctgaaaatctactaagaaaaggaaagcctctcactccaaataatttggtcctagctctctttactttggtttccatcgcagtgagtattctcacaactggcatagaaatcattttattacttgtatagtacagggattaaaagcctcatgagtaaaacccattaaaaactattgaagatttaatgagagagtccatcagctttcttagcaagactcagaagggcattgagaaaacatacaaaggaacccagaaacaatggagggccaaataattcttaaggataaattcatagctcagctggtgccagatatatggagaaagctccaaaaaaaattggcttttggccctgatcaggatctggagcacctcctcagagtatgttataatcggggccaggaagaatgaaaagagaacaagaagagagactgagaaaagactgaggctctggttatggcgctacagggagtcaacctgggagtttccaaggtgagaggactagggcagagacctatgcccggagtctgtttcctctgaggaaaagagggaccttttaaatgggaatgccccaagactcagagatcactggaagagggattgcccctgaagacaaaggtctctatggttgacccctcaggcccaggatcaagactgatggaacatttccataatggctcctgtccttatcaccacatagccctgggtgactctaaatgtaggaacacagagccacttttcagtcctcctctccaatcctgggccccacgctcatgaatctgccacatttatatttctggcaagccggttacaaaattctttacacaacctttgagttgtgactgggaatccattttcttttctcaatacctttctgattgtttcagagtccagatcctcttttagaaattcttaaaatatggaaggtaactacatacatgttgttacagttgtcaacattaggtataatatattatcgtacctaggtttaacagaagtcaaatgagacactgaaacatcagttactaaacagaaactaaaggtctttagaatgattaaccaatatgatcagtgccaccctgaaatggtctctataagaaaaacatgtgtttttagaaattataaaagtcagtccgtggttgctttagaaaagtaggatgagtgtgttttcaatatagaaggaatgaggaatggaattgcatcttcaaaagaaagatagtctgtcttcagctgattgctctacttggaaaataagggacagactaatatggataagagaattttgaacatggtagggactgtttagaatatatttgagtaagttaactttaaggtgatgccatagatcatactgttcaaaaggacataaggtagctttccattgcatgctgaccaaggcatacaaatgtttcataaccagccagagaaatcagaagaatcatgagttacctgtgctattataaaatctaaatgttgtattcctgattgttcacagaatgtgtctaattccctgctagatcatcatcaatagattcattagctgtcaatccagctccagtttttggagctgccctgtggaaccagctgacctcctcctcctggtgaaaatatttctttgaggtatccaaagcaatgttatcaaagcccacttgaccattccatgagtggagacctaactgctttcccctaacgacgccccttttcagcaggaagaagttagagcggtcgtcgccccttttcccacagttagagtctccaactcaaaagggggggaattaaggtagatttttaactcaggtagtcagtgtagggatatgggctttgatacattctttgtggctatttattaacatttgtaaactgagggtcacatagcaagcccaactgctataaaggttgcaggtattgccccatggatccatcacatcagagtgaagaaggttgcatccgctgctgacatggacaccggggaggctgtacagcacctcgagagtcttcatggtcaagttccagagactcctttcgccatcatcagagtgctaagccctgctctggccacccatggaagctggtcagtctatgcacagcagaagcctgaggagttccacgtgagacttaaaacttgaactctgagacttaacttggactgtgttcggtctaagtgaataattcaagaagaaatgaaaaaagtttcaagacctatttttgtcttcctgcaaaaacaaaaagggggagatgttgcaagacatgtttccttgaaaactccatcttgtccttctttactttatcccatcttcttgtcttactttatcccatcttccttcttggagaaacagtcacagtgctggtaaatgacttaagtttaagagcaaagacctaaaggcataagtgacttaagcttaagaactgttatgtgcctagaggtcagagtaagagcttaaccctttaccacctaagtggctttctaaacaaaccctgtatcatccacccatagccactcctcacttaatctcacaataaaagcagtgtggtttcttgaggca

SEQ ID NO: 227 - DNA, 10465 bp, artificial
  ss2038 sequence
tgatgactaagcaaagtctaaccaactgccccaaccccccctcccccacacatgtgcttctgtaaatttgtttccacatctactaccttgcctgacatcactcaggtccaactagccaagcatggacccagaagaggtagcccataaaagccttgtgaaacccttcttcagggctcagactctggagatcgatctcctctgagcctgccagtgtaataaacctgagttctccaactctccgagtgcttgcttggtgtcttgccaggtaaaagagctgatccactgcagccacagagctgctggagctagtatgctacagccacagggctgtcaccagagctgatatgctgtggcgcagggatggtgggcagctgccttaacatttctggaggcctcagtgagattccaactgttctggccccttgagccaccggaacagaggcaaggccacccaggacttggggagcctcaaaccaaacgaggcgcacaccacccgatggtattccgggtcctccttcgtgagcagcattcctgactcctgggtgactgaaccatgactggactcagtggagagatggaccaactcaccagaaaggcatcaggataaggcaaggccctggggccaaccccagtcaggtcctgccccagtggacagaagaggggactgatcacccccttagggagactctcccacttggaagctgtgcctgaccagagcagtagtcctagtgctccagatcagaagcagaggaacctcttgcttgggtggagcaactgtcgggcataaccagttgaaagttgtgcttgatcgagctactagttagggattcccagggagtggaaagcattgtgataacctctgagtgtgtgtgagagtgaatgtgtggcctgattcatttgcgcttcaggttcaagtttgtggctccacggtcttagtggctacggagtccgagtgggtcctaacctgcagttccatggtgacctcatacagcttatggctgtagcagactctgaggtttctcttccctccctgtgagtccaatccaagttcggggcttatacaaaccagccaattgctaagaggcacctaaactcccgagagggggcggtcaggcggacatctgaatggccaccttctgaaaaggaggcaccctcccttgttttgtctgtgacactggcacaggatggccacacagggtgggacctaacccagaagcccatgagccagagatccctgtgctcccaccatttgggccataaattcctccaaggtgataatctaacttgaccttgcccctgggccttcaggaactcccggcccatattctaaacaagccatgggactaccaattttgtcagttcatggaggcccaggatctgagtcagggagactagcctgtcatccccagctcagttcagggtatagggaagattgggtatgaggtcccctgtcctttgcccgaaacattagaacttgtctgagagtgccttcctgagaccgggggtccagatggatctgagatacttgcaacaaagcaggtactttccacagtcatagagtgagctaagtgggatctgtcttgctttcaagagtggtggaggcaaagctactggggataccacccacgaagtcagagaaggtctcataatatcaggccatagaaaagatccacagaaagacacgatgtgttcacccaggtctaaacctatggttgtaaactgtgttatcaaagatttcaaaaagggattttctgaagattatggtaaaaaaataacctgatctttcatcatttcctttgccattacctcaaatagagctgtgggggcaaaggaaacagacctctagatgttaagaccatcctgagttgttaccaggcctgtgggggaaaaggagttcatagctagtattcatccaacttaggccaagtgtttagcctcagagcctcagcatagtcagttttgctttttgctatttactttcaccctggttggagaaattgatggctggttcatccaatttacctggtaactgtggcttagaaactttcttaatgttaatacagggcatgtcagagtgagcatcttaggattcaaaaactcagggcagggcctgtatgcctgggttttcttcacctctgtccagagacaggcaatggacaggaatgatgggaagagaggctaagctggtaaagagtggttaattccagtcagtctgaggtcggatgggacatttgaccactaatgtctagatgctccatgtaagagaggggacgccctcacatagccaagaaaggacaataggcactggatgctggtcttttctcttttttggataggagccacattctcaagcctggtgcacagctcaatagcaactcctctgacaagtgccttgaagaactggaaaaagtttgactctgagattctgaaaaagaaacatttaattttcttttgaacaaaagcctggccactatataatctgtcagatggagagcgatgaccatctgaaggctctctagcttataatactattctccaattagccagaagttaatcagccttctccaatactgctcaagtctcctcctctccccaagccagtgccaaagttatatctctctctactccctttcaagaagtagcaaacagagaatggggaccaagtacaggtccatacacctatttcacttcaggacttaaggcaaataaaaacagatttgggaaaatttgctgatgacccagatatattgaggtctttcaggtctttgcagtcttttgagttagcctggaaggatgtcatgttattacaaaaacagacattgactataagtggaaaaaatacataaagtctttgaaactgctcaaagctggagaaggtgaatggaatgatgctataaatgccagaggcagattagaagaggaatgaacaagattctcccacacggtgtcaggcagttcctatgagcaatcccaattggtctgctgatgagggagataacaaaaattggcatagaaatcattttattacttgtatagttgagggattaaaagcctcatgagtaaagcccattaaaaactatcggaggtttaccaggggaacaagagagtccatcagttttcttaaaaagactcagaaaggcattgagaaaacatacaccaaggaacccagaaacaatggagggccaaataattcttaaggataaactcatagctcaattggtgccagatatatggagaaagctccaaaaattggctttcggtcctgatcaggacctggagcacatcctaagagtagcaactcaagtacgttataatctggtccaggaagaatgaaaggagaacaagaagagagaagagaaaaggctgaggctctagttatggcactacagggagtcaacctgggagtttccaaggtgagaggactagggcagagacctatgcccagagcctgtttcctctgtggaaaagagggaccctttaaatgggaatgccccaagactcagaccacagcacctagaccatgccccatatgttggggagatcactggaagagggactgcccctgaagatgaaggtctctggggttgacccctcaggcccaggatcaagactgacaggacatttccataatgacgcctgtccttgtcacaattcaggagcccttggtgactctaaatgtaggaagacagcccagtgacttcctcctgaatatgggagccccttttcagtcctcctctccaatcctgggcccctccctcatgaatctgccccatttatatttctggcaagccagttacaaaattttttacacaacctttgagttgtgactgggaatccattttcttctctcatgcctttctgattgttccagagagtgcaactcctcttttagaaagagatattttgtaagaggataaagcctcaattcacataacaatggaggatttcccatcatggagcagcagaaacaaatccgactaggaaccattaggttgtgggttcaatctctggctttgctcagtgggttggggatccagcgctgaggtgagctgtggtatagattgcagatgcggctaggatcccacgttgctgtggctgtggcataggctggcggcttcagctatgattgaacccctagcctgggaacctccatatgctgcaggcgaggccctcaaaaaaaaaaaaaaaaaaaaaaggcacatggcaatggagcctaatcaaggtttatgcctgccttcagtggaagtatatattgacccagaagtctgggccataggaggaaacataggaagaacaaagaatattcaactgatggaaataagtcttaaagatcagaatttatttctttgccaaaagcagtatcctctgaggcccaaggcatgacagggacttatcccaattataggaagcataagagaacagattattaattgaatctatcagcccttgtaacactcctatattgagagtgcaaaaacttaacagggattggttcctagtacaagaccttcatctaataaatgagacactggtctcattacatccagtggtgcccaatccctacactcttctttcacaaattccagaaacagcagcatgggttactgcattaaatttaaaagatgcctttattctgcatttccttgactaaagctttgcatatataatatctcaaaatatgtaaggtaactaactgaccagaattaattttaggttcaagtagactgggaaatattgagtattaaattaatatcttaaattagaattgaagtttgctgatctaattaatacgcacatgtcattacagccgtcaacattaggtataatatcttatcatacctaggtttaacagaagtcaaatgagacactgagacatcggttactaaacagaaactacaggtattttgaataattaatcgatatgatcagtgccaccatgagatggtctctataagaaaaacatgtgtttttagaaattataaaggacagtccatggttgctttagaaaagtagaatgtgtgtgctttcaatatagaaggaatgagggatggaattgcattttattaaggcaaaagaaagatagtctctcttcagctgattgctctggttggaaaataagagacggactaatatggatacagaaagtgatacaaggtgtgtgggaagtggacactgagaagagaattttgtgcatggtggggactgtttagaatatatttgagtaagttaactttaaaagtaaggtggtgccataaatcatactgctcacaaggacataaggtagctttcaattacatgttgaccaaggcatacaaatatttcataaccagccagataaatcagaaaaatcatacagttacctgtgctattataaaatctaaatgttgtattcctgattgttcacagaatgtgtctaattccctgctagatcttcaacagtagattcatgagctgtcctatccagctccagcttttggagctgccttgtggaaccagctgacctcctcctcctggtgaaaatatttcttcaccatatccttttattcagaccctgtataattaattgtatttcttgcttaattacatcctgattaaaagctatcaaccttcaaatactgatagaaggggtacccaaagcagtgtatcaaagaccacttgaccgtcccatgagtggagacctaacttctatccctaatgatgtcccttttcagcaggaataagtcagagtggtcattgccccttttcccacagttagagtctccaactcatgggggggagtggaattgaggcagaatattaactcaggtagtcagtgtaggaacatggcctttgacacatcctttgatgtggctattggttaacatttgtaaattaagggtcacgtagcaaccccaactgctataaaggttacaggtattaccccatggatccatcacaccagaataaagaaggctgctcctgccactgacacagacacctgggaagctatccagcaccctgagaacccccctcaggatcaagctccagagacattcggcaccagaggatggcaggccctgctctggtcacacccagaagctggccagtctatgcatgacagaagattgaggaatctacagccctgacccagccacatactggaagttggctggtttgtacaagtagagaccagaggatctccatgcaaacttgaactgaactcatgctctggtggggaatattggtaattgaaattgccacagccctcatattttgagtggggctatatgtgggatccccttcagaatagggacagggaacccagctgttcatctgtgtgatgtatctcctgactgtcagtatactaggatccctattcataatgggtcagtgaaaaggattaagggaatcatagttctgttaacactcactgtgctgctcactccaggggcgacagactgagacgatgatctacgggatgggacaggattaacagatgcttaccagtgcctccctgctaattagacagggacctgcaatctagcctttgtcactcctcaaatagatattgtccctggaaatcagtctcttatggtgcccatagaggcacatggcagaacaagagagcaatacaaattatcccctaattagttagtttgggaatttcagcagggaaaggagtgggaagaatagcatcctctgctgcttattatcatccactatctaaagaattcacagatgacatggaacaagtagccacttccctagtagccttacaggataaggtagactctctggcagaagtggcccttcaaaacaggagagcactggacttattcactgctgaaaaagggggactttgcctgatgaagaatgctgtctttatgccagtgcagatctggaatagtcagaaacatggcccaacaactaaaagaacacatagcaaagagaagggaagaatagataactcctggttaaagtggggtaactactggagttgggtggcatggcccatgcctttggctgggcccctcttcctgctcttcattaccctcacatttgacccctgtatccggaactgtcttgtcaagtttgtctcctcgaaatcacaacggatactgcagaaatacaaaaaaccataagagaatactatgaacaactatatgccaacaaatttgacaatctggaagaaatggacagttttctagaatcttacagccggccaaaactgaatcaagaagaaacagatcaactgaacatacccatcactagaaatgaaattaaagaagtcataaaaacactccctaccattaaaagtccaggaccagatggcttcacaggtgaattctatcaaacatataaacaggatctggtgtccatcctccttaaactctttcaaaaggttgaagaagaaggaatactcccaaagacattctatgatgccaccatcaccctcattccaaaatcagacacagaaaacatcaaaaaagaaaactatcggccaatatctttgatgaatgtagatgcaaaaattctcaacaaaatcttagccaacagaatccaacaacatatcaaaaaaatcatacaccatggccaggtaggggttcatcccaggttcacaaggatggttcgacatctgcaaatcaatcctcatacaccacattaacaaaagaaaaatcaaaaatcatatgatcatctcaatacatgcagagaaagcatttgacaaagttcaacatccattcatgatcaagaccctcgccaaagtgggtatagagggaacattcctgaatataatcaaagccatttatgagaaacccacagcaaatataatactcaatgggaaaaaactgaaagccttctcactcaagtctggaacaagacagggatgcccactctcaccactgctcttcaacatagttttggaagtcctagccacagcaatgagacaaacaaaagaaatcaaaggcatccatataggaagagaagagataaaactgtcactgtatgcagacaacatgatactatacatagaaaaccctaaggactcaacccaaaaactacttgaactgattaataaattcagcgaagtagcaggatataagagtaacattcagaagtcagtcacatttctgtataccagcaatgaaatattagaaaaggaatacaaaaatacaataccatataaactgccccacacaaaatcaaatacccgggaatacacctgaccaaggaggaaaaggacttatatgccaagaactataaaacttgaatcaaagaaatcaaagaagatgtaaagaaatggaaagatattccatgttcatgcattggaaaaatcaatagtgtaaaaatggccatactacccaaaacaatctacagatttattgcaatccctatcaaattacccatgacatttttcacagaactacaacaaacaatccaaacatttatatggaacaacaaaagacccagaatcgccaaagcaatcctgagaaaccaaaaccaatcaggaggcataactctcccagacttcaagaaatattacaaagccacagtcaacaaaacagtgtggtactggtatcaaaacagacacacagaccaatggaacaaaatagagaacccggaaataaaccctgacatctatggtcaattaatctttgacaagggagccaagaacataaaatgggaaaaagaaagtctattcagcaagcattgctgggaaacctggacagctgcatgcaaagcaatgaaattagaacacaccctcacaccatgcacaaaaataaactccaaatggctgaaagacttaaatatatgacaggacaccatcaatctcctagaagagaacataggcaaaacactctctgacatcaacctcatgaatattttctcaggtccgtctcccaaagcaatagaaataaacccatgggacctaatcaaactgaaaagctttggcacagcaaaggaaacccaaaagaaaacaaaaagacaacttacagaatgggagaaaatagtttcaaatgatgcaatggacaagggcttaatctctagaatatatatgcaacttatacaacccaacagcaaaaaagccaatcaatcaatgggaaaatgggcaaaagacctgaatagacatttctccaaggaagatatacagatggccagcaaacacatgaaaaaatgctcaacatcgctgattataagagaaatgcaaatcaaaactaccatgagataccacctcacaccagtcagaatggccatcattaagaagtccacaaataacaagtgctggaggggctgtggagaaaagggagccctcctgcactgttggtgggaatgtaaactggtacagccactatggagaacagtttggagataccttagaaatctatccatagaacttccatatgactctgtaatcccactcttgggcatctgtccggacaatactctacttaaaaaagacacatgcacccgcatgttcattgcagccctattcacaatagccaggacatggaaaaaacccaaatgtccatcaacagaggattggattcggaagatcgaatactactcagccataaaaaagaatgtcataatgccatttgcagcaacatggatggaactagagaatctcatactgagtgaaatgagctagaaagacaaagacaaataccatatgatatcacttataactggaatctaatatccagcaaaatgaacctttcctcagaaaagaaaatcatggacttggacaatatacttgtggatgcctgatgggagagggagagagtgggagggatcgggagcttggggttatcaggcacaacttagaatagatttacaagtagatcccgctgagtagcattgagaactttgtctagatactcatgttgcaacagaacaaaggttggggaaaaaatgtgtacatgtaaggataacttgatctccttgctgtacagtgggaaaataaaataaaaataaaaagtttgtctcctcttgcctagaatctataaagctacaaacagtggtgatgtctgggccacacttatatcagcccctgggccaagaagaccagaaaagttgatgcttgctccaaaaatgtgaaaaagcatcaagagggggtaatgtaggagaaaacatcccaataaaaatatagaaagagagaccctggccatgatgactaagcaaagtctaaccaactgccccaaccccccctcccccacacatgtgcttctgtaaatttgtttccacatctactaccttgcctgacatcactcaggtccaactagccaagcatggacccagaagaggtagcccataaaagccttgtgaaacccttcttcagggctcagactctggagatcgatctcctctgagcctgccagtgtaataaacctgagttctccaactctccaagtgcttgcttggtgtcttgccaggtaaaagagctgatccactgcagccacagagctgctggagctagtatgctaca

SEQ ID NO: 228 - DNA, 4405 bp, artificial
  ss2051 sequence
gggttagtgagacactttttggaacactttcaggagcataaagagaagcctatgccttcttctctgcctcagactaatccctttctcaatgagagtttaaataagcctttagctgtggaggcaacatgaactccctttcaattggctttaaaatctgctagtctagaagatcagaactttttagcatgccctataaatactgccactgatcctcaagttccaggacaaaatatccatatgcataacacttctgattttaaagctcttagagctccttgtgatagtataatacagaatggagatacagctccctttactatgagcatggtagaaatcatgggacacttcagcttcctccatgggattggcatatgatagctaaagccaccctagatggtggagactatttaatttggaagtctagtcttacagattttgtcaggaaaaggctctcttaaatcagagataatgttctaattacatttgaaatgttggttggaacaggccgttttcttgacttagaaaacaaactgacaatatgaactgttgagccccatcacccaaagagcatggatgacaattcctgaaagaggaaatccacaaggatcttttgtacaatgccttcaaggccctacagaaccttacccacaatttttggaccacctaactcaagtgatatggtgccaggtggcacattctcaagtagctgatattttaaataaacaattggcatatgaaaatgcaagtaaagactgtaaaagggcaactgtccaggtaaaaaaattcagggggcatctctgattatattaaggtgtgcaaagatatagggagtacaggtcatgataaaggaatgctagttgcagcgttgaaaggaatgcttggcagctcaggaaagaaatgttttaattgtggaaaagaaggacattttcagaaagaatatttagctcaattaaaagggaaatcatccctaacaatgggaccatctctgggacctaagaataaccctggtttttgtcctcattgtcagaaagaaaataatatggttaattaatgtcagtctaagttttataaaaatgttactccattagtaactctggtgttgggaaccccctcctccttggccccttcaaacaatgaaggcttttgtggctcaacctaaaaggaaaccaatccatccaaggaccactcccaacttggactttccctgcaccacagcagcagttttaacatattaacagggcattcagggtattcctactggaatttatggctctcttaatcatgatactgtaggccttattataggaagaagtggtttaaccatgaaatgtttacaagttttgcctggggtgatagatacagactatcaaggagagattaaggtaatggcaaaatctaaaactacacatactttgaaactggaatgagaattgctcaattgttattgctgccctctcttagaataggagcgttgtcaaaaggaaaggggaacatcaggatttggaagttaagggacttctcaggtcttttggactcaggaagtgacaactgaacttccacaaatgactattaaagttaatggaaaaaatataaggggattaacagatactggatcctatgtttaggttattttttatggtgattggcatccctcatggcctttaattacccccaaaatgaagttgatgagattaagagttccaactacagtccatcaaagtcagcaggtgctttcctggatcggaccagaaggaaaaatgttttgtttttgttttttttttaaatcttacattgctgatatacctgtcactttatggggaagagatctttctcctatgagacttaaattaacaactgaggatgtctatagtggcaattctaatgattcttcccctggatggaaattaatgaaaaaattagggtaccaaaaacaaactggtttgggaaaaaacaatcaaggcataaaagaacctataaattttcccattaagcttaataaacatgaaataggatttgatgaggattttcagtgggggccattgaaaattttccactagtccttgcagatcctatacaatggattaatgatgatccaaattgagtagatcaatgccccctaactcaggagaaattgactaaaatacataagctaatagctcagcaattacaattaggacagactgaggaaattaacagccaatggaatactcttatttttactattccttaaaaatatgttaaagggaggctattatacaatttaagagaaattaataaaacaatatatattatgggtgctttacaacctggcttgccttctcctactgcaattcccttagattgtgttctaattgttatagatttaaaagattgctttttcaccataccattagcccctaaaaacaaatgtagatttgctttctctgttcctcctttaaatagcaaggagcctatgaaatgatatcaatggaaggtactgccacagagcatgaaaaatagccctaccatgtgccaaaactttgtggattgagacttggctcctattagatttaaatatcccaaggcatatattacccattatatggatgatattctcctctctgctccaaaagaacaagtttttaacatcttactaggtaccaaagtatatcttaatgaaaaggagcttattatagccccagataaaattcaaaaggcccccttttcaatatttggtgaccctaatagagggtgatactattcagccacaaaaaattcagattcacagggatcagttaaatacactaagttattttcaaaaattattaggaggtattaattaggaattactacaaatcaattaactcatctttttaaaacattgaagggcaatcctgacctttcctcttcacatacatcgtcttctacagccctcaaaaaattacagccagttgaggaaaaataaatgaggcacaattacaacatatttattatgataatcctattattctaattgtgttgctttccataaattcacctacagtggccctagttcaagaaatgccacattttgtctttgttgaacggatctatctttctagtcaagaagtaaatatagaaacactttatgtggacctcatagctaagattattagccaaggaaattgattggagtggatccaaatattacacatacccctctggacaaacttatgagagaaaatttattccaaacctcgatgccatgacagacttctttagctggatatccaggggaactttataatcatccacccaaaaataaacttacaaaattcctatgagagacccattttatatttctaaaaattaccagatcacagcctattgctaaagctcttatattacagatggatcttcaaatggtaaagctggtattcaaggtccaaatattactaaaattatacaaatttcttacacttcagctcaaaaagcagaactagtagctgttcaataaattttaagaataattttgtgtccttgtaatattgtttctgattctcaatatgtgttgaaattagtgtagaaactagaaacagccaaattaaatgaattaaatgatgaggagttatttcaactgtttttttgtagcaacaaattattagacagaggacatcactttttattactaatatacactcttatacttctttaccaggtcctttgcatgatggtaatcaaatggtggaccagtttataacttctattgttgaacctactcatgcttcacatgcacttctccatcaactcacagcaatgtgtatagacagtttagtctgtctcatgctgttgcacaagatattattaaatcctgtccatcatgccaaagcttagcccaggtatctaccaatgatggagtcaatcacagaggattaaaaattaatcaactgtggcaaatggactttactcatgttaatagttctgttcatttaaaatttgtttatgttattgttgacacatattcctctgtctttggggctcagctgaggtaggtgagactttttgacatgtcaaaaaccattgtttagaatcttttgctattctgggtcttccacaacatattaaaactggtgatggtcctgcttgtgctagtaaggcttttgctgaattttgtcaagtttggtaatttttcatgtcactggcattccttataatccccaaggacaagctatagtagaacatgcacatcataaattaaaactccaacttaaaaaacaaaaggggggacaggaaggctcctctacccccacaaggttattaagacaagatttgcatactatacattttttcacctgtaatgaagaaggaatgatgcccatggattggcactatggccagcatattgctggtacctccccattagtatactggaaaacacctgaggaga

SEQ ID NO: 229 - DNA, 8479 bp, artificial
  ss2069 sequence
tgaaaactccatcttgtccttctttactttatcccatcttcttgtcttactttatcccatcttccttcttggagaaacagtcacagtgctggtaaatgacttaagcttaagagcaaagacctaaaggcataagtgacttaagtttaagaactgttatgtgcctagaggtcagagtaagagcttaaccctttaccacctaagtggctttttaagtagtaaaagaacttatataatagtaaacaaaccctgtatcatccacccatagccactcctcacttgatctcacaataaaagcagtgtggtttcttgaggcagagtgctcttggtccctgagaccttgagttccctggctcccacctttacttaagataaatgtcctctgagtcttgttttatgttaactatttttccttaagttccacagcacccgttcttcagccccatcctgctgagctggccccagcaagtggtgcccaacgtggggcaggctcacaaacaggcaggcacgaggaacgaaggaccgtgactacagtggaaattttattcactggaagcgctgtggagccctgagaagggaggaattttgtgtggccacgctaaagaaatcctgcagataagttccctctctcaggtatttacggggtaaaatgggaaactataatccttacatttgtttgtttggacaactccttaaaaagggggctgcaaaaacaagtgaaagtaagcttttggaactttttcagactattgagagacattgtgattggctttttacatcagaaacattatatttaaagatatgggaaatggtaggaatggaacttaggatattgcaggatgagggcattcgaattcctgtgtccatttggagtacttggaacttaattaaatcagttttagaacttccagagaccacagaggacttagaggaagaagggaagtttacacctttgttggaagaatctaaatatgcagcccctgaacaaaattatcatagagaatatctggctcctgagcctttggctccaattgttgattctgatattcctcaattgcctcctattaggagtaaggtgatgaggactcgtcaagcttctacttcttctaggtttgtaaagaaaatgagcgctatccctgaacaccacctatcatccattcaacagggaattttacaggctcgaagggaaggcgatttggatgccatacatttagcctttccagtaactgtcagggagacagtggctccaggcattgatcccgccaaccctgatggagtttacgagttcattcatgagccctttccttttaaaattcttaaagaattaaaacaggcccttcaaaactatggtgttaattctccctttacaaaaggaatcatgcagggagtagctgaaggaaatcatatgattcctgctgattggcataacataaacccatgctgtgctatcacctagtgaatatttataatttaagtcttggtggcaagatcatgaccaaattactgctaattgtaatcatgcttggaaatcttccccattacaatggaacaattgctagggattggtccttggagtaatcttcaagatcaattaagaatgaatgatttggctattgaacagattagacaatgttgcttaatggcatgggataaaattgaatctatgggtcatatatttcttttcaaaagatcctacaaggccctaaggaaccttatactgaatttctagctcgtttacaagaggcattaaaacgacaagttactaactctaaggtgtctgatactatttttcaattgttagcatatgaaaatgcaaatactgatttcaaaaaggccataggatttttaaaaggaaaagctaacatagccaaatatattaaagcctgtcagggaggggggacggagtcctttaaggcctaaatgctagcccaagcaatggctaatttaaaagttaaagacaaattttcaggaaaatgttttaattgtggtaagacaggacatattaaaaaacaatgtcgcactcttccacgagcccgacctttctttcacggagcttcggcaccttctagtcacaataataaacagcccagactatgtccaagatgtaataaaggaaatcactgggctaaccaatgccggtccatctttcataaagatggaaccccttgttgggaaactaccctcggggcaagcttccagccccgtcaaccaaggaagctttccccattcagaacaagagccagactctctggaactacgctctgcaccagcgctcgacatcacagtagatctccctagtttagaggatttaattctccttcctagcgaaactcctacttctattacaaccaagttggaaaatccattaccatcagatacaataggattgataataggaagggcagagataacagaacaaggaattcgagttcataccaggatattggataataacggggatgataaagtacaagtgatggtttccactgtgatttcttggaaaattaaaaaaggggatcagattgctcaaatcttaattttacctagagtccagaagaaaaaagacaggaataattttagacagaagagattcaataccacaggaggggcaggagtgtttttatcagaaaaggtcctagaggaacgacccacttgtcaagttatcataaatgggaagtcttttagaggattgattgatactggtgctgatgtttcaatcattagccatttacattggccagacacctggcctcttcagccagctgatattgaagtctctgggttaggaaaagcagagggtctcaaaaagagtgcccaatggcttaattgtgaaggaccagatgggcagccagttcgattgaaaccttatgttgctcaactccctatcaatctatgagggagagatttattacaacagtggcatgcaaaaatttacttaccgccagtagattaatatagtcatcaaagccaaaaaatgttgcagaaacagggttacattcccgcattgggattaggaagacatcatcaggggagagtggaacctattgaatctgagattaaaatggacaaatctggtttgggatatcggccttttcattagcggcaactgcttgtaaaaataattatgtttctcctgaacctattcgactgaaatggactacagaaaaaccagtttgggttgagcagtggcctctttcttcagaaaaattaaaggttttaagtgatctggtccaagaacaattagagaagggccatatagaagaatcctttagtccctggaattcaccagtatttgttatacagaaaaaatcaggaaaatggagattgttaacagacttaagaggagtaaatgctgtaattcagcctatgggtgcccttcaaccaggcctcccatctcctagtatgataccagctaactggttgttaattatcttggacctaaaagactgctttttcacaattcctttacacccagaagataaggaaaaatttgctttttcagtcccagtggtaaacaatatagcccctagaaagcgttatcaatggaaggtcctgccaaaaagtatgttaaacagccctacattgtgtcagtattatgtggcttcagttgttgagccagtccaaagacaatttcctaaatgctatattgttcactatatggatgatatactttgtgctgcaccctctcagcagcagctgactgaggttttccaatgtttacaaacctgtctaaaaggagcaggattggttattgctcctgaaaagattcaaatgaaaagtccatatcaatatttgggaactgtggttgaacataccactgttcaccctcaaaatgtagaattgagaagagatgaaatttctacattaaatgatttacaaaaattgttaggagacattaattggctccgaccttatttggggattcgtacatatgaattgtcaaatcttttctccttgcttagaggagattctaaattaaacagcccccgctctctaactgcagaagtggaagaggaactaaaaaagattgaaagtaaaatacaaaactcccaactaagtcgggtcaatctaaaacaacccattcagttagtaattataccttctcctcattctcccacgggaatattaatgcaattagaaaatattctcgaatggctttttcttcccaataatgtcacgaagtctttgtctccgtacctggacttgatggcacgacttattctaaaaggtcgcactcactgtgtacaaatgtccggaaaagatttgaatcatgtaattgtcagtttaactattaaggaaatccaaaattgttttcaaaatcatataggttggcaaattgcctttgcagattacgtaggatcaatagataatcactatccaaaaaaccctgttttacaatttataaagcatactcaatggattctgccaaaaaaggtgaaggagtcacccatcattgacgcccctgtgatctttactgatgggactagtaaagggaaggccggatatgtggctaatcaatctaaaattataagaacacctggcctttcagcccaacaggctgaactaactgctgtaatccatgccttgaggtattatcctgagcctatcaatattctttctgattcagcatatgtagttcatgctgccaaaatgattgaagctgctaccattaagcaaaatttacctgtcttgttatttgacttgtttacaaaattacaaactgttgtaagggaaagaagatatccattttatattactcatatcagagcacatactaacctacctgggcctctagttgcaggaaataaagaaattgactgtttggtgacacctgtgttacaagaagctcaacattttcatgatttaacacgtgtaaatgttcaaggccttaaaaagagatttggaataacatgggctaaagctaagacgattgttcgtcaatgtcctgcatgtcaaattattaacaatccttctcaatctgagcctggagttaaccctagggggcttgtccaaaatgctctctggcagatggatgttactcattattcatcttttggaaaattgtcatttattcatgtatgtattgacacttactctaaatttatttgggctactgcgcagtctggtgaatctgctaaacatgttattcatcatttgtatgcctgttttgcagtcatgggcctgccacaagcaattaaaactgataatggtccagcttatatcagttctcaacttaaaacatatacatggcatattgctcactctactggtctcccttacaactcccaaggacaggctattgtggaatgagccaatttatatgtaaaacaggctcttcaaaaacaaaaagggggagacacagaaatagttaagtcacaacaaacacttttaaacaaaaccttattcactttaaattttttaaacttggcctctgatgaaaaaacagctgcagagagacatttttatacagaacaaaattagattaactttcctcatgctgaacagcccttgatttggtggcaggatccaccaacaaacttctggtctccaggaaaacttattacatggggtaggggatatacttgtatttcaccaggtcatggattacaacctgtttggattccatcaagaagaatcaaaccatatcatgagcaagcttgtgaagcatcccttgactccagaccccagaaggaggatgatgagggctcatcttcctcatcttcccacttgaggtcaaatcaaacatctaacccaagaagctgaaaatctactaagaaaaggaaagcctctcactccaaataatttggtcctagctctctttactttggtttccatcgcagtgagtattctcacaactggcatagaaatcattttattacttgtatagtacagggattaaaagcctcatgagtaaaacccattaaaaactattgaagatttaatgagaaagtccatcagctttcttagcaagactcagaagggcattgagaaaacatacaaaggaacccagaaacaatggagggccaaataattcttaaggataaattcatagctcagccggtgccagatatatggagaaagctccaaaaaattggcttttggccctgatcaggatctggagcacctcctcagagtatgttataatcagggccaggaagaatgaaaggagaacaagaagagagactgagaaaaggctgaggctctagttatggcgctacacggagtcaacctgggagtttccaaggtgagaggactagggcagatacctatgcctggagtctgtttcctctgaggaaaagagggaccctttaaatgggaatgccccaagactcagatactggaagagggattgcccctgaagatgaaggtctctgtggttgacccctcaggcccaggatcaagacttatggaacatttccataatggctcctgtccttatcaccactcagccctgggtgactctaaatgtaggaatacagagccacttttcagtcctcctctccaatcctgggcccctccctcatgaatttgccacatttatatttctggcaagccggttacaaaattctttacacaacctttgagttgtgactgggaatccattttcttttctcaatacctttctgattgtttcagagtccaacttctcttttagaaattcttaaaatatggaaggtaactacatacacattgttacagttgtcaacattgggtataatatcgtacctaggtttaacagaagtcaaatgagacactgaaacatcagttactaaacagaaactaaaggtctttagaatgatgaaacaatatgatcagtgccaccctgagatggtctctataagaaaaacttgtttttagaaattataaaggagagtccatggttgttttagaaaagtaggatgagtgtgttttcaatatagaaggaataaggaatggaattgcatcttattaaggtaaaagaaagatagtctgtcttcagctgattgctctccttggaaaataagggacaaactaatatggatacagaaagtgatataaggtgtgtggcaagtggacattgagaagagaattttgaacatggtggggactgtttagaatatatttgagtaagttaactttaagttgatgccataaatcatactgttcaaaaggacataaggtagctttccattgcatgctgaccaaggcatacaaatgtttcataaccagccagagaaatcagaagaatcacatgagttacctgtgctattataaaatctaaatgttgtattcctgattgttcacagaatgtgtctaattccctgctagatcatcatcaatagattcatgagctgtcaattcagctccagtttttggagctgccctgtggaaccagctgacctcctcttcctggtgaaaatatttctttgaggtatccaaagcaatgtatcaaagcccacttgaccattccatgagtggagacctaactgctttccctaacgacgccccttttcagcaggaagaagttagagtggtcgtcgccgcttttcccacagttagtctccaactcaaaggggggaattaaggtagatttttaacttaagtagtcagtgtagggatatgggctttgatacattctttgtggctatttattaacatttgtaaactgagggtcgcatagcaagcccaactgctataaaggttgcaggtattgccccatggatccatcacatcagagtgaagaaggttgcatccgctgctgacatggacaccagggaggctgtacagcacctcgagaatcttcatggtcaaattcgagactccttttgtcatcatcagagtgctaagccctgctctggccgcccatggaagctggtcagtctatgcacagcagaagcccgaggagttccacgtgagacttaaaacttgaactctcgagacttaacttggactgtgttctgtctaagcgaataattcaagaagaaatgaaaaaagtttcaagacttatttatgtcttcccgcaaaaacaaaaagggggagatgttgcaagacatgtttccttgaaaactccatcttgtccttctttactttatcccatcttcttgtcttactttatcccatcttccttcttggagaaatagtcacagtgctggtaaatgacttaagcttaagagcaaagacctaaaggcataagtgacttaagtttaagaactgttatgtgcctagaggtcagagtaagagcttaaccctttaccacctaagtggctttttaagtagtaaaagaacttatataatagtaaacaaaccctgtatcatccacccatagccactcctcacttgatctcacaataaaagcagtgtggtttcttgaggcagagtgctcttggtccctgagaccttgagttccctggctcccacctttacttaagataaatgtcctctgagtcttgttttatgttaactatttttccttaagttccacagcacccgttcttcagcccca

SEQ ID NO: 230 - DNA, 11127 bp, artificial
  ss2075 sequence
tgatataatcaccaactgtgtgcacatgtgtaactctgtgacagcatgacataatcagtatccatgtgcaactttgtaacatagaccatccaaccagaatttacagaatgtacattatcttataagggggaaaaaagtttcaaagggtaaaagaaaaaaattatggagggcatataaaacagtactccactctgtttggggttaagcctttggatgtgaatcctcttagccagtgctggcatgaagaaatgctgattcctggcaaatagccttggtgtcccatctctctgtatgaaaatcctgcaacatttcttgggggctcgttcaggattccaagatggtgatttaacctcccttgttattggggtgtgacccctgggacatcaggagagatgacttcacttggtatgagaggaccaattgatccataggggcctagccctcccaacatgccggggcaataaacccaggagcacaaatgtacccagtgaggcccaggaatcagccaagggagcatccatgtcagaccggttaagacccaggtttggtttggtaaaactgcccttaagaggcagaaggggaacctgattacctcccagagttgcccaagtagtctcacaggagatgaaaccacaactttagggcactgggcagtgggttggagacattgtatgaatgtaagagaatgagagggacaaaaggagatttctgactctatcaagggctgaagcaagtgtgtagtcccaatccatggccgtggtgatcctcatatgtcttatggtggttatccgcagagagatcctgatgtttggctttatacagtcccaccaatgctaagagacacctgaaataactgcgaggagaatggctggagatgggcaaaaatgattgtttactgcttccctttcccttctcgtgagtgactgtcatcttttagggggaggaaatgggtggaaaatagagtaaacttacccctttagagtgtatgataaaacaatttcaagaggggatattcaggagattacagtattaagttgactcctgggaaactttggacattctgtgagatagattggctttcattccaggtgggttggccctccaaggggtcactagataaagaacaagttagcaaagtgtttagagttgttgcaggggacccagcctaccttaaccaattactgtacattgactcctggcaagacatagtcttctcttggccacttggctgaaagcctctctggaagagaactgtaaaatcatgatggaatgaatgacagctccttcaaaatgccaaccagaaccctagaagcccattatctctagggagccagaggacattcctccacattatgcacaaatgtatccctcaataccactggcaatccctgcacctactgtagctgaaaccacaccggaggccacccatacccctgaagccaaccctcccacaaagccattcaagacacccccaaccatagccattccagagctgccagtctgaaccccatatactccagtggggaggcaccaggaagcccctgcaggcaatcacccacctcataggtgccaaggtgccttaccaatgccaatgagggaacctcagggatggtcatatacaaggcggccaacttactttcatatatcagtcttttaccaccactgatctcctgaactggaagaaccttactccctcactcactgaaaaacctcagactattattgatctaatgcaattcatcatccagatgcacaagcacacctggactgattgtcaccagctactcttgactgttcagcactgagaagcactgctgaattactcgggcagctttaaaatggttggaaaaacactccccagcagggacaatgaatgtgcaggcttatgcacaagaccagttccccaagaaaaatccccagtgggacccaaatgatgcctggggatttcaaatgcttgagcactaccaagaggctcttttaaggagcatgaaagagggaggggaaaaggctatgaatatgagcaaaacctcagaagtgctccagggatctgaaaagagcccaagccaattttatgagaggcttttccaagcattcctctttacactcccttagacccagaagccactgagaatccatgggtggttaacagactttgttctctaggcccccggagacatctgacataagctacaaaagttagagatgaaatgaatgccagccaaattttggagtttgcaatgatggtatttgtcaactgagaccaagagtcatgacaagaagctgactgaaaagaaaaagaaggcagatctgcttgctgctgccttggtggattgatcaggacactcccagagaggtgccccactgggctggggctgagatcagagaaggaaaggacaaggaggaacacctctccctgagaatagattaggatgaaatcaattagctcaatattaccaggctggtcactggaagaacaagtgtcccaatgagtcagaaaattcttacctagctcctggaaagagagggaggagccaggtgattcaaagatggtaccaaccagtgcagcaaccatataaggcccctgaagacaattttgttggtctggctgccatgggaaactatgaggaagactaggacagaccgggatcctttctgtttggccccaaggagactacagtccaaatgactgtagggtgctggcccattgactttatggtagacaccagggcagaacattctgtggtgacccaacctgtggtccccctgtcacagagacaagccactattgtgagagccactggcggccaaacccgttgtcctttcttactgccttgaggatgcaatttaggcatccatgaagtcattcataaattcctatacctgcctgactgtcctgtggctttgatgggtcaggaattattgggaaagctgcagacccagataactttcatttcccatggccaagcaactctgaccctagggaaaacaggagcaaaaatcatcactcttaccatcccccaaggagaagaatggtgactctacagtcttatacagagcccacaacagggacctgagctttctttcaagctacttgaagtatgggctgaagacaatcaccccagactggcccaaaacatacccccaataatagtagaactacaaccaggtgttgaacctgcctgccataagcaatatttcattccttccaaggcacaaattaggatccagaaacatgtggggagtcttctaaagtatagaatacttctaaagtatggaatcctctgaccctgccagttgtcttggaatgtgcctcttctgccagttcagaaaccaggagcagatgactactggccagttctggacctgtgagcagtaaactaagccacccttaccctggacccagtcatccctaacccctacactctcttgtgccttattacttctgaggctgccttctttatatgccaggacttcaaagctgccttcttctgcatccacctggcccttccaagtcaaccgatctttgtcttccaatgggaaaatccagaaaatggtgacaagggacagctgacctggactaaaatgcctcaaggattcaaaaattctccaactatctttggcactgcattagcctctgatttaaaagacttcccagcaaaccaacatggctgtacattacttcaatatgtggatgacctattactggctgggcagaaacaggaagaatatatggaacagacatgtctgctcctcaccctcctatgggaggctggctacaaagtttcaaggaaaaaggcccatatctgtcaagaaagggtcaaataattttggtttcacctatcccaagtacaacatcgactcagcccagagagaaagaaggctgtctgctcattcttggttccatctacccaatgccaggttggggaatttcttggggccacaggtttctgtagaatctggatacccaacttttccatcttagcaaaaccccattatgagaccacaatgtggggagaacagaaatctctgttgtgggaatgagagcaacaaaaggcatttgaagaaatcaagtgacccctcacctacatgcccagcctgggactcccagacatctccaagccctccttcttgtacgtgcatgagcatactggtgttgcaagtgggggtcctgacccaaaggttggggtcatggcatcatccagtggcatacctctccaagcaacttgactccattgctcaaggatggccgccctgcctatgggcacttgcagccacagctctcttagtgtcagaggctgacaaattgactatgggaaaagaactgacagtccaagtaccacactcagtattgacattaatggaatgtatataagggacaatactggctaacaaactcccagatggtcaaatatcagggaatgttatatgaaaacctgcacattcacctagaggtattgaggaccctaaaccccacaaccctactacctgttgggctgggtcagccagaccatggttgtgtcaaagtcacagatggggtattctctaggtgatctgacttaatgtccaacccctcaaagacccagactctgagtatttcaccaatggtagcagttctgtaaaagagggagaacaccttgctgggtattctgtggtgaccctgaattccaccattgaggcaaagtctctgccaaatggaacttctgtgcagaaggcagaactcattatgctaacctgagccctctaactggcagtggggatatgtgtcaatatatacacagactgtaaagaggccttcaccaccctccacatacacagggctttatacaaagaaaagggcctgatcaactcaggaggaaaggacataaagtatggaaaagaaatccttaaactcttagatgctgtgtgggcccctaaatgggtggcagtcatacattgtttgggaaatcaaaagggagacaccatggtcccttggggaaactgtaaagtagactgagaagcaaagctcacagcctccaaggggacattggaaccagcagctctgactgtcgcactgttccttagtccattggcagaatgggaccctaactactcacaacatggaaacacttggtttaaaacagaaaatgggaacaaactcccaggtgggtgttgtaaatttaaagatggctgagtagcaatacctgaggccctagccccaccccttgtcagtttcaccaggatactcatattggcagaatggctcttaagaacacattgggctgacacttctacatccctcgactttacagcatagtctgggtagtatgcaaacaatgtgaaacatgtgcctgaaatagcccatgtcaaggagctaagaccatctttggagtacagagtctttgaagggccccatttaaaaatatatttatggacttcactgagattcactgagtccgaggctataaatatctgttagtctttgtgtgtactttctcaggttgggtagaggtcttccttactcacatggagaaggcacatgaagtggcccaatttcccctaaaggaaaccattccctgatttgaaatcccagtcaccatggaatcagataatgggcaggcattcctagctgaggtggtataattggtggcaaaggggttaaagataacctagaagttacacagagcatattgtccccagagtgctgggaaagtggagtgaatgaactgaactctaaaattgcaaccaagtaaaatgtatcaggagacccacctacactgggacctaatgttgccaatttctctgttaaggattaggtccagccctactagagagacagggttttctccttatgaaattctttatggacaccctcctcccattatcaggggcatatgagggggatctgaaggcactgggcaatattatcctgagacagcagatgcaaggtcttggctcaacccaaaacactatacaccattgggttagggaatggttacctgtgagcttgatcacagatgcccacccctttaaaccagaagatgctgtatgggtaagcgtggaatgtccaacccatacagctcctctggaagggcccattcactgtcattttatccacctccactgcagtgaaggtagctgaggtggtcccttggattcaccacagcagagtgaaaccagattcccaaggttgggaatgccatttggatctatcaacaccatgcaagctgaccatccataggaagcagattgcgaccccagagaccttagaggaccgcagccctgctttagtcattccagaagctgactaatctatgcatggcagaagcttgaggaatcagtttcctgacaggattaatagactggttttgttttatgttttggttctcttactgtgatgcatcatcacaccttgtacctgtctgttattgtgattcttgccctaatctttgccacagggttgtcagagaccactcaggccaactggaatgtggtgaaatgtttctggtagtgctctcttttctcttgtgtgtaggatgttttgttgatgttggttgcctctgatttgggcccctgttgtagacctaaattccccatcttgtgacccatgcatccacactactcaacatgacgaatgtgtcaccaagatcttactttaccacacccatttcacttgccagggagaagtcttggggacctgcaaacacaacaagaccacctattttctctcccaacaggagaatcagtacacttgtttcaacccatagtactccccaagggaagaatgtttagagatggggtgaatttaatttaccgaacccaggttactcatcctcacccacctgtgtcaatactttttgatgtatgtgggaccatcagtaataactggtcatgtttaaaccatgtgggggcctatattgggaatgagagtacagacttaatgacaaatatatgtgtgaaaagtcctggagcttatgtgatgacccagattattcttactgcccctactggagctgtgttacatgggcaccttggaaagataaagacaaaacagcacacctcaaacagggtatagccaaccccaactgtaccttaggagcctgcaaactcattaattttactatcctagatccagaggaccctaggtggaaaaatggccataagattgttgtacacatctatgggcatggcattgacccaggaactatattgtatttcaagagggtcacattcccattctgttcctcaactcattaggtttttcattcccttttttaaaaatttattcatttatttatttttgattttttatagttgatttataatgttctgtcaacttttgctgtacagcaaagtgacccagtcatacatctatatatacataccttttctcacattatcccccatcatgttacatcacaagtggctagatatagttccctgtgctataaagcaggacctcattgcttgtccactccaaatgcaatagtttgaatctactaacccgaaactcccagtccatcccactgcctccccctcccccttggcaaccacaagcctgaaaaaagtgttttctatattttccaaagtttctccaatgaatgtattaattatataatagaaaagattttcaaaataaagaggaatctatctttgcttttcctttctagtttatcaatgtaaaacaaaaagcaagtgttaaccgcaggaaagacataagaattgcattagttttacaaacaacagtgaaaataatgacacccaggttatcatctcaagcgatctgtaggacagaatacacttttctgaaaaactgacttatgctctgctaagaagcttttactattttaattattgagatcatgcaatattgcttttatttcattttattttttattaatcaaatgaatttatcatggctgtaattgtataatgatcataacaatgcaatttcacagtattttcatcccataacccaagcacatccctgcaacctccaaactgtctcctctggagaccataagtttttcaatgtctgtgagtcagcatatgttctgcaaagaacttcagtctgtcctatttttagatcccaaatgtcagtgaaagcattttatgttggtgtctcactgtatggctgatttctcttggcacgataaattctatgtccatccctgttgctaaaaatgctggtatttcattcctttaatggctgagtaatattccattatgtatatataccacatcttcttgatccactcttctgttgatggacatttaggttgttgccaggtcttggctattgcaaatagtgctgcaatgaacattggagtacaggtgtctttgcaggtaatcatttttctggatagatgctcaggagtgggattgctgggtcaaatgttatttctatgtgtagatttttgaggaatctccatactgttttctgtagtggttgcaccaatttaaaatccaaccaagagtgtaatagggtacctttttctccacactgtctccagcacttattgtttgtagactttttgatgatgggcattctgggtggtgtaaggtggtacctcagagtggttttgatttgcatttctctaatcatgagtgatgttgaacatgttttcatgtgttttttggccatatgtatgtcttctttggagaacggtctgtttagaaattctgcccattttttgatgggtttttttgtttgtttgtttgtttgttttgtttttttttttttttttttttttttttttttggtcaggagctgcagaaggtgtttataaattttggagattaatcccctgtcagttgattcacttgcaaagattttctcccattctgtgggttgtctttgttttctgtttagggtttcctttgctctgcagaaactttgcagtttgattaggtcccatttgtttatttttgtttttattgtcaatactctaagaggtggatctgggaagatgttgctgtcatttatgtcagagagtgtttggtctaagttttcctctaagagttgccttggggcttctcagtgctgactgacaggtggggccagattttcccaaaatggccatctccagagaaaggcatgctgctgaatattcccaagagctttgctttcaatgtccttccctcacaacaagctgcattcacccctgttttcccagaatgtcctccaagaactgcagtcaggtttgacccagattcttgtggagacttgtctttgccctgggacccagtgcatgtgaaagtctttgtgcaccttttaagaatgggtctccttttcccccagtcccatggagctcttgcacacaagccccactggccttcaatgccagatgctctggggctctttctccctctgccagatccccacatgtgagagtttgatgtggagctcagaactctcactgctgtaggtgagtctctgtgaaccagttagtttccagtctgtggggcttcccacctgggaggtatggggttgtttatatcatggaatcacccctcctacctcttcatgtggcctcttctttgtcttctggggtaggatatcttttttaaggtttccagtgcatttggtcgaggattgctcagcctttcattgtgaattttgttgtttttaggagagaagttgaactccagtccttttattctgccaccttaatcccatctgttctttcattccttttatgaggaaatagaaaatagcctacctcccatctctgtcacgagcagaaaactgtatcttgccctggcagatactaaagcctagatgctaaatgtttcttctcattatgtacattgggaactaacatgggagatccatggccatgggaggccagagagctagatagccatgaatcttatacccaaatcctgctaccaagatttggcttcttaagaactcaatcatagtcaataactgccttgtccaatggggaggatgattcagcacttctgttgggagactgatgtgcctgggccagagattctataatgtaaatgcccagaaaacacaatggtggggttttctctgaaccaaatcctcatcccttgtccaatttccctcatctctgacaggtttgagatgaagttgatgctaacattacatggtaggcccaaggtagactacactggatatttgggagaacagcccatactgtacttcccccaaactggtcaggatcttgtgtgtttggggtctattcatccattcttcttcctgctcccacttaccagaggagaacatttgggagttcaagtgtatgaggacagggcaacccaaagaaaacagcatgccttacaaattggagaatggaaggatgatgaatggccccctgagaatataatccattaataaggtccagccacctgggcagaggatggatattatggataccatactcccatctatatgttaaactggatcatcaggttacaggctgttgttgaaattataactaatgaaactgcaaaaggccttaatatagtagccaagcagcaaatcaaaatgcatattgctatctatcaaaacaacctaaacttagattacttgttggtctatgaaggagggatttgtggaaaatttaactgaataattgctgcttacaaatagatgatgaagggaaggtaatagaggtaatcacagactgaatgagaaaaattgctcttgtcccagttcaaatctggagaggctggaatcccaaaaatttatttgaggaatgttttttaacttttggaggatttgaaaccctcataggtgttgtgtttttaattttggggccttgcctgatgccatcctgtctagcccccccttgtaataaggtctgtctcctccctcatagaagccatggttgaaagaaaaattgccacacatgtaatgatattatggaaatataaactcctaaatcaagattatgctctttgacccaagagaggggtctgagcgtcaaaaggggtaagggggtaagggccctcccagaacaaagggaaggtaatgtggcataaccagcaactgtgtgcacatgcataactctgtggcagcataacataatcagtatatatgtgcaacttcgttaacttagaccatccaaccagaatttacagaatgtatgctattttataagtgggacaaagggacca

SEQ ID NO: 231 - DNA, 2802 bp, artificial
  ss2079 sequence
aaagagaatacccaaggccaagatgaagatcaagccctatttcaggctggattggtagaaaccctcagaacttatacaaatagacccaaacacttttgaagagaacattgtatttgcaacccactacataagccaatcagccccagatgtctattggaagcttcaaaatcttgccatggggccccatactcctctcagcctccttattgacacagcctttagtgtctttaacaatagggaccaggctgaggaggaaaagaaggaacagcatgactttaggaatgatggcaagccagccattatgacaagacctaacccacctcttgttcatctcaaaagtactcctggagtacctttaccaggaaagggagcttgttataactgtggagattctgaacactgaagcaagaaatgcccaagaaacaggtcccatcctacacccaaaaccccacgcccactctgcaggaagatgtgccactggaagaggagcgaggaaattctcctatgccagtcatgtcaatggttgattgatgggaccaggacctcccaaggctcccaagaagatagtcatcatcacatgggaggaacaatgtgtgaccattaatgtggcaagtaagtttgtccagtttttagtggacatgggagccacttactctgtcctgacttctcactctgggcccctttcccctgaaacctgatctacttttggggtagaaggaaaaccaaagttaaaatatttcactacccctctaaattgcacctgagaaaagactattaaaactcacaagtatcttgtcatgcctgaatgcctcagcccataattaggaagggattttctctcagccttgggggcaactcttactttccctgaaaagcaaagctagggaatgtttttggtttgactatgtattatacaatacatggatagtacagctcaaaatattccttctgaagttgaaaaacttatagatccacaggtctgggatcagggaattccagggaaggaaaaattgtcactcctataaaaatcaccctaaaggagactaataacttcctttatagacaccaataccccacaaaggcagaggctcaatgaagcctccaaccactcatctcaaaattcatcaaatatgggcttttggtgccatgacagtctccctataatactccagtattacctgtcctcaaaccaaatgtgaaatatagaatggtccaaggtttctgaatcataaattaagctgtaattcttcttcatccaattgttcccaccccatacacaatccttgctgaaatcctcaaggacaaagcctggtttatagtctttgatcttaaaaatgccttcttctgtataacggttcaccctgattcccaatactttttttgtttttttgtttttgaatggactaacctagacactagtgaaacccaacaatatacctagaccgtccttcctcagggattccaggacagcctacacctttttggaaatgacttagctaagaaacaaagggatctaaaagtagagacaggggcattattacaatatgcagataatctccttatcttcagctcctcaaaggaagtttcagatcaaaatactgtacaggtccacaatttcctgggctccaggggatataaagtatccccaagggaagccaaaatttcatccccaaaagtcacttacatgggacatattctatgcccagggaaatgtgctttcataacccagcatgaggaagcaatcctccatttacaaccaccacatacaaagaaatagctcagaacttatttaggaatggctgggttttgtaggattttgatccctgggtttagtctcatggcaaaatcatatgaggccttaaagggaccagacatggaacctctagattggacagagaacttacaaaaagcattttatcagattaagactgtcctgactagtacccaagccttgggaatcccagatattaataagccctttactctatttacctcagaaaaaaacagaagttctcacccaaaaggtagggccaattccatgaccagtggcttatctctcaaaacaattggattcagtagtctcaggatggccaggctgtctgagaggtgtagtagtcacagccctcttagatgaacaggccacaaaactctccatgggtcaacccctggaagtactgacaccacaccaggtacaaggaggtattagaaattaaaggacatcattgactgactggaggacacctcacaaaataccaagccctccttatagactctcctgaagtaactctaaaagtatgtcagaccttaaatccagccacccttaggcctatacaaagcccagaggaattgtttcattcttgtactgagaacattcaacaggtatattctagcagacctgacctcagggaccagcctcttgacccagatgctgtctggtttactgatggaaatagttatatacacaatggcatccaggaagcagggcacgccatagtagatttacatgagaatagagactgatgccctgcatcgccaaacctcagcacaaaaagctgagcttagagccctagcttgagatctcatgctaggaaaagacaagaggatcaacatctatatagattctaagtacacatttttggagttaaatgcacatgctatttggaaacacaggggactcttgactgcatggggctccccagtccagtgctgccagggaatatgagaactcctagaagcagtacaagaccctaaggagttggcagttagtcactgcaggggatatcagagggggaaatcagacat

SEQ ID NO: 232 - DNA, 8731 bp, artificial
  ss2078 sequence
tgaaaggatgaaaatgcaacctaaccctcccagaacccaggaagttaataaaaagctctaaatgcccccgaattccagaccctgctcgctgccagtaaataggtagaaggtcacacttcttgctgttccagggcctgttatcctggcctaagtaagataacaggaaatgagttgaccaatcgcttatccggattctgtaaaactgactggtgccatagaagaattgattaacacattgaaagccctagtgacctatctcaactgcaatctgtcactctgcccaggagcccgcacaaatgcggacctctggagctgttttaaaatgattggtcctcggagcgtgggctctcgatactttaaaatgattgttttgcgacgcacaggctttgttgtgaaccccataaaagctgtcccgactccacactcggggccgcagtcctctacccctgtgtggcatatgactgtgggccccagcacgcttggaataaaaatcctcttgctgtttgcatcaagaccacttctcgtgagtgatttggggtgtcgcctcttctgagtccggacgagggggatttttccttccactggcctttcatttgatgcgttggccgggaaatcctgtgaccaccccttacacccgagaaccgacttgaaggtaaagggatcccctttggaacgtgtgtgtgtcggccggtgtctctgttctgagtgtctgttttaggtgatgcgcgctttcggtttgcagctgtcctctcagaccgtgaggactggaggactgtgatcagcagacgtgctaggaggatcacaggctgcctccctgggggatgccccgggaggtgggggagccagggacgcctggtggtctccttctgtcggtcagaggaccgagttctgttgttgaagcgaaagcttccccctccacggccgtccgactcttttgcctgcttgtggaagacgcggacgggtcgcgtgtgtctggatctgttggtttctgtttcgtgtgtctttgtcttgtgcgtccttgtctacagttttaatatgggacagacagtgacgacaccccttagtttgactctcgaccattggactgaagttaaatccagggctcataatttgtcagttcaggttaagaagggaccttggcagactttctgtgcctctgaatggccgacattcgatgttggatggccatcagaggggacctttaattctgagattatcctggctgttaaagcaattatttttcagactggacccggctctcatcccgatcaggagccctatattcttacgtggcaagatttggcagaagatcctccgccatgggttaaaccctggctaaataaaccaagaaagccaggtccccgaattctggctcttggagagaaaaacaaacactcggccgaaaaagtcaagccatatccttgtatctaccccaagattgaggagccaccaacttggccagaacctcaacctgttcccccacccccttatctggcacagggggctgcaaggggaccctctgcccctcctggagctccggcagcggagggacctgctgccgggactcggagccagagaggcgccaccccggagcggaaagacaagatcgagacattaccgctgtgcacctatggccctcccatgccggggggccaattgcagcccctccagtattggcccttttcttctgcagatctctataattggaaaactaaccatccccctttctcggagaatccccaaagcctcatggggttggtggagtcccttatgttctctcaccagcctacttgggatgattgtcaacagcagctgcagacactcttcacaaccgaggagcgagaaaaaattctgttagaggctagaaaaaatgttcctggggccgacgggcgacccacgcatttgcaaaatgagattgacatgggatttcccttgactcgccccggttgggactacaacacggctgaaggtagggagagcgtgaaaatctattgccagtctctggtggcgggtctccggggcgcctcaagacggcccactaatttggctaaggtaagagaggtgatgcagggaccaaatgaacctccctcggtatttcttgagaggctcatggaagccttcaggcggttcaccacttttgatcctacctcggaggcccagaaagcctcagtggccctggccttcatagggcagtcggccctggacatcagaagaaaacttcagagactagaagggttacaggaggctgagttacgtgatctagtgaaggaggcagagaaagtgtattacaaaagggagacagaagaggaaagggaacaaaggaaagaaagagagaaagaggaaagacgtgatagacggcaagagaagaatttgactaagatcttggccgcagtggttgaagggaagagcagtagagagagagagagagattttaggaaaattaggtcaggccctagacagtcagggaacctgggcaataggaccccactcgacaaggaccaatgtgcatattgtaaagaaaaagggacactgggcaagggactgccccaagaagggaaacaaaggaccgaaggtcctagctctggaagaagataaagattaggggagacggggttcagaccccctccccgagcccagggtaactttgaaggaggaggggcaaccagttgagtctctggttgataccggagcagagcattcagtgctgctacagccattaggaaaactaaaagataaaaaatcctgggtgatgggtgccacagggcaaaggcagtatccatggactacccgaagaaccattgagttgggagtgggacgggtaacccactcgtttctggtcatccctgagtgcccaatacccctactaggtagagacttactgaccaagatgggagctcaaatttcttttgaacaagggaaaccagaagtgtctgtgaataacaaacccatcactgtgttgaccctccaattagatgatgaatatcgactatattctcccctagtaaagcctgatcaagtcctggttggagcagtttccccaagcctgggcagaaaccgcagggatgggtctggcaaaacacattcccccgcaggttattcagctgaaggccagtgctacaccaatatcagtcagacagtaccccttgagtagagaggctcgagaaggaatttggccgcatgttcaaagattaatccaacagggcatcctagttcccatctgagccccttggaatactcccctgctaccagttaggaagcctgggaccaatgattatcgaacagtacaggacttgagagaggtcaataaatgggtgcaggatatacacccaacggtcccaaacccttataacctcttgagcgctctcccgcctgaacggaactggtacacagtattggacttaaagatgccttcttctgcctgagattactccactagccaaccactttttgcctttgaatggagggatccaggtacgggaagaaccgggcagctcacctggacccgactgccccaagggttcaaaaactccccgaccatctttgacgaagccctacacagagacctggccaacttcaggatccaacacccccaggtgaccctcctccagtatgtggatgacttgcttctagcgggagccaccaaacaggactgcttagaaggtacgaaggcactactactggaattgtctgacctaggctaccgagcctccgctaagaaggcccagatttgcaggagagaggtaacatacttggggtacagtttgcaggacgggcagcgatggctgatggaggcacggaagaaaactgtagtctaaagacttttgcgttatggtccaaattgtcccctgggtgtattaccatcccgaaaaagcggtccttgatgaatatgactatagatataatcggccaaaaagagaacccatatccccgacactagctgcaatgctcagattgggagtggctgcaggcatgggaacaggaacggctgccctaatcacaggaccacgacagttggagaaaggacttggtgagttacatagaattataacggaagatctccaagccctagaaaaatctgtcaacaacttagaggaatccctaacttctttatctgaagtggttctacaaaacaggagaggattagatctgttatttctaaaagaaggtgggttatgtgtagccttaaaagaggaatgctgcttttatgtggatcatttgggagctatcagggactccatgagcaaacttagataaaggttagaaaaacatcacaaagaaagagaggctggccaaggatggtttgagggatggttcaacaagtccccatgggtgaccaccctgctttctgccctgataggacccctagtgatactgctcctgttgcttacagttgggccttgtttaattaatcggtttgttgcctttgttagagaacgagtgagtgcagttcagatcatggtacttagacagcagtaccaaggccttccgagccaaggagaaactgacctttagccttcccagttctaagattagaactattaacaagagaagaagtggggaatgaaaggatgaaaatgcaacttaaccctcccagaacccaggaagttaataaaaagctctgaatgcccccaaattccagacccagctcgctgccagtaaataggtagaaggtcacacttcttgctgttccagggcctgttatcctggcctaagtaagataacaggaaatgagttgactaatcgcttatctggattctgtaaaactgactggtgccatagaagaattgattaacacattgaaagccctagtgacctatctcaactgcaatctgtcactctgcccaggagcccgcacaaatgcggacctctggagctgttttaaaatgattggtccacggagcgtgggctctcgatattttaaaatgattgttttgcgacgcacaggctttgttgtgaaccccataaaagctgtcccgactctacactcggggccacagtcctctacccctgcgtggcgtacgactgtgggccccagcacgcttggaataaaaatcctcttgctgtttgcatcaagaccacttctcatgagtgatttggggtgtcgcctcttccgagtccggacgagggggatttttccttctactggcctttcacctccatgtaacctattccccatacaaataatgtatccagcatgggaatataaaaacaattataaagtgtggcaggtcctcttttttacctgtgtgcaggccctctttttacccatgtgcaggttctcactctctctctctctgaacatgtactttcactttactaggtttataaaacaccagtcatttcaattatttgctacaattaggcaggaactgaggaaactgcaattctatcattctgtaacaaattctatcgtagtgacaaaaagcaaaataccaaaataaattagcatgatgaaatatatattctagtgtccaagctaattaataaaatgtttctgattcagaagaaaataaaatattttggaatctggttttgtaacaagtagaaacgcattttatagccaacactaacatagtattagatggttattaacaataaatgaatgccaagataaaataagtagaatattttaaaaagagtaatcatgaaatgatttatgtagtctccctgttttatcctgggttttatgtattcattgaacaaacatttattgaaaacctaatatgctccagtctctgttataagagctgctattttaacccccttccctgtatatgaattataaaattaaaatgtgagtaacacaaatacacagctcatattttcacctagtgtgttaaatcatctctctcagccacacaattgtctgactatctgagagaacattacaaaatttcttgtgctgccaaactccaaagcagcttttatgagttttagatgaatttgattctaatgtttatatgatatttctcattcccttaaacagctttccttattgtggacttaccagttgctcacgaaggactttgatctttcttgttttaccattcattcataaagcattttttgagcacctatactgaatcagcatccaggtttagcatttgaggtatatataaacagataaaataaatacaagagccaatttgaaaaaaatgctacattttaacacacatctgttaaaaatctgagaacagaagacaagaacatacttccagttataaatttaccttctctcattacttatacatcaataaaatgagaatttagaaataaaaaactacacacaaataagagagggggcattgtaagatgagagatttcaaaacagttttagaaaataaatttttggtaagttagcaactgtttcagtagaatagcagagaaagctacaacctaaagatgagcaagaatatattggtatttgcccaatagaactatgaaaagctcaagacttggagtccctagaatacaggagagagaatatgaggcaaaggacagaaaagaacagaggtgagttcaaaagcttcaatttcctttcagttggtaaatcttagaaggccggaggtttattctctagaaaaagtgaacagaataacctcagaactgctgagggcaggagtgagaccaaaaccagaaaaacagagggttaattgaaactcttcaatacagaatagtcttgtatttccagcctttgtactctgcacttgaagaatactggcaatgaagtgattacctatcagaaccatcctctcttcataatgtacctcaggaaataataataataaaaaaatcctcttctctggataaaacataaccctgaaagaaaaatacctccacacactgagacaattttctaaccctgaaagaaaaatacctccacacactgagacaactttttttaaatctcttttagcaggaaatcaataaacaaggtctaaattgataaatcaagaaatagaagaataaggcacactatatagagtctattttgggggtagactaagctaccataacaaatacacatcaacaatttagttactctggaaaaagaagtctatttatgtcttatatagaaatcaatgactattccagaataagaggccactctgcttaattcagcctttcatgactttaactaaagtctgcttccccacaccttcttattgttgttaatctggctatagagacagggaaagaaaatatggaagagctgtgttttatgtcaaactaagttcatgtgtatgatggacagtgaagccaagaaaaccaaaatgtcagagtttggagcacagaaagggttattgcaaggggcaaataaggagtacaggtgttttgtgctcaaaagacccaaactccctgatggttttcagggaagagcttttataggcaaaatttggagggagggggtacagggtgtgtgactgtcttcatattggtttgtggtgaggtaatgaaaggatgaaaatgcaacctgaccctcccagaacccaggaagttaataagaagctctaaatgcccttgaattccagaccctgtgccctataggtaaaagatcatacttcttgctgttttagggcttgctttctgtacaaaactatgtggaagggggaaaacaggtccctgagtatgtgcctctaggcatgaaacttcttgaaactgcttgagataacagggaaaagggttcctaactgcttgtttggcttctgtaaagctgcttgcataagataaaaaggggagaagttaagcgcctaaccgaccccagtaagatcggttgcgccataaaatgttgaaaatcctgataaatatatcttggcgacaatatgtctcccccgcccaggaacaggcacaaacatgtatctccagaacaacttaaaattaattggtccatgaagcgcgggctctcgaagttttaaattgactggtttgtgatattttgaaatgattggtttgtaaggcgcgggctttgttgtgaaccccataaaagctgtcccgattctgcactcggggccgcagtcctctacccctgcgtggcgtacgactgtgggccccagagcgcttggaataaaaatcctcttgctgtttaaatcaagacctcttctcgtgagtgatttggggtgtcgcctcttccgagtccggacgagggggatttgcattggactgtccttacagtaacagggtggtgctccagggatcttatgctcagcttaaagttaccatcctccacctgggtgaggctttagttcccagtagaagaactcaaagatatgtatcagactgttatgtatttccattggggacaaactaggattctgcttaattgttacaatattgtttcttgactgcttttcctctgtttctgcattccctcacttatctattgaggaatcatttgaatctttactttggaactcaggaaagcctacaaacaagaaatgggggacacagaaaggtttttgcactcaggagggacttccagtgtcacagtttgtttcattttttttttcccaaggcagtggcccagcagtgactaataccaattcttccactagaaataacatagtcatgtggccatatcaaattacaaggggagctgagaaatgtgatatctaagtaggcagccttgtacccaattaaactccaacagtctaggagagatatgtattttagtaaagagataatagtctctgcttcataaagataaaaaaagagaaaaaaaaaagaagggttg

SEQ ID NO: 233 - DNA, 8488 bp, artificial
  ss2085 sequence
tgaaaactccatcttgtccttctttactttatcctatcttcttgtcttactttatcccatcttccttcttggaaaaacagtcacagtgctggtaaatgacttaagcttaagagcaaagacctaaaggcataaatgacttaagcttaagaactgttatgtgcctagaggccagagtaagagcttaaccctttaccacctaagtggctttttaaatagtaaaagaacttatataatagtaaaccctgcatgatccacccatagccactcctcacttaatctcacaataaaagcagtgtggtttcttgaggcagtgctcttggtccctgagatctggagttccccggtgctcttggtccctgagaccttgagtccctggctcccacctttacttaagataaatgtctctgtgtcttgttttatgttaactatttttccttaagttccacagcacccgttcttccccatcctgctgagctggccccggcaagtggcgcccagcgtggggcaggctcacaaacaggcaggcacgaggaacgaaggaccaccactacagtggaaattttattctctggaagtgctgtggagccctgagaagaagggaggaattttgtgtggccacgctaaagaaatcctgcagataagttccctctctcaggtatttacggggtaaaatgggaaactataatccttacatttgtgtgtttggacaactccttaaaaaggggggtgcaaaaacaagtgaatgtaagcttttgaaactttttcagactattgagagacattgtgattggctttttacatcagaaacattatatttaaagatatgggaaatggtaggaatggaatttaggatattgcaggatgagggcattcgaattcctgagtccatttggagtacttggaacttaattaaatcagttttagaacttccagagaccacagaggacttagaggaagaaggggagtttacacctttgttggaagaatctaaatatgcattccctgaacaaaattatcatagagaatatctggctcctgaggcttcggctccaattgttgattctgatattcctcaatcgcctcctattaggagtaaggtgacgaggactcgtcaagcctctacttccagggttataaagaaagtgagcgctatccctgaacaccgcctatcatccattcaacagggaattttacaggctcaaagggaaggtgatttggatgccatacatttagcctttccagtaactgtcagggagacagtggctccaggcattgatcccgccaaccctgatggagtttacgagttcattcatgagccctttccttttaaaattcttaaagaattaaaacaggccgttcaaaactatggtgttaattctccctttacaaaaggaatcgtgcagggagtagctgaaggaaatcgtatgattcctgctgattggcatagcttaacccgtgctgtgctatcacctagtgaatatttacaatttaagtcttggtggcaagatcatgcccaaattactgctaatcgtaatcaggttcgaaatcttccaattacaatggaacaactgttagggattggtccttggagtaatcttcaagatcaattaagaatgaatgatttggctattgaacagattagacaatgttgcttaatggcatgggataaaattgaatctacgggtcaaataaatatttcttttcaaaagatcctacaaggccctaaggaaccttatactgaatttctagctcgtttacaagaggcattaaaacgacgagttactaactctgaggtgtctgatactatttttcaattgttagcatatgaaaacgcaaacactgattgcaaaaaggccataggatttttaaaaggaaaagctaatgtagccgaatatattaaagcctgtcagggagtggggacggagtcctttaaggcctcaatgctagcccaagcaatggctaatttaaaagttaaagacaaattttcaggaaaatgttttaattgtggcaagacaggacatattaaaaaacaatgtcgcgctcttccacgagcccaacctttctttcacggagcttcagcaccttctagtaacaataataaacagcccagactatgtccaagatgtaataaaggaaatcatgggctaaccagtgccaatctatctttcataaagatggaaccccttgttgggaaactaccctcggggcaagcttccagccccgtcaaccaaggaagcattccccattcagaacaagagccagactccctggaactacgctctgcaccagcgttcaacatcacagtagatctccctagtttacaggatttaattctccttcctagcgaaactcctacttctattacaaccaagttggaaaatcctttaccatcagatacaataggattgataataggaagggcagagctaacagaacaaggaattcgagttcataccaggatattggataatatcggggatgataaagtacaagtgatggtttccactacgattccttggaaaattaaaaaaggggatcggattgctcaaatcttaattttacctagagtccagaaaaaaaaagacaggaataattttagacagaagagattcaataccacaggaggggcaggagtgtttttatcagaaaaggtcctagaggaacgacccacttgtcaagttatcataaatgggaagtcttttagaggattgattgatactggtgctgatgtttcaatcattagccatttacattggccagacacctggcctcttcagccagctgatattgaagtcactgggttaggaaaagcagagggtctcaaaaagagtgcccaatggcttaattgtgaaggaccagatgggcagccagctagattgaaaccttatgttgctcaactccctatcaatctatgggggagagatttattacaacagtggcatgcagaaatttacttaccaccagtagatcaatatagtcatcaaagccaaaaaatgttgcagaaacagggttacattcccggattgggattaggaagacatcatcaggggagagtggaacctattgaatctgagattaaaatggacaaatctggtttgggatatcggccttttcattagcggccactgcttgtaaaaataattatgtttctcctgaacctattcgactgaaatggactacagaaaaaccagtttgggttgagcagtggcctctttcttcagaaaaattaaaggttttaagtgatctggtccaagaacaattagagaagggccatatagaagaatcctttagtccctggaattcaccagtgtttgttatacagaaaaaatcaggaaaatggagattgttaacagacttaagaggagtaaatgctgtaattcagcctatgggtgcccttcaaccaggcctcccatctcctagtatgataccagctaactggttgttaattatcttggacctaaaagactgctttttcacaattcctttacacccagaagataaggaaaaatttgctttttcagtcccagtggtaaacaatatagcccctagaaagcgttatcaatggaaggtccttcctcaaggtatgttaaacagccctaccttgtgtcagtattatgtggcttcagttgttgagccagtccgaagacaatttcctaaatgctatattgttcactatatggatgatatactttgtgctgcaccctctcaggagcagctgactgaggttttccaatgtttacaaacctgtctaaaaggagcaggattggttattgctcctgaaaagattcaaatgaaaagtccatatcaatatttgggaactgtggttgaacgtaccactgttcaccctcaaaaggtagaattgagaagagatcaaatttctacattaaatgatttacaaaaattgttaggagacattaattggctccgaccttatttggggattcctacatatgaattgtcaaatcttttctccttgcttagaggagattctaaattaaacagcccccgctctctaactgcagaagcggaagaggaactaaaaaagattgaaagtaaaatacaaaactcccaactaagtcgggtcaatctaaaacaacccattcagttagtaattataccttctcctcattctcccacgggaatattaatgcaattagaaaatattctcgaatggctttttcttcccaataatgtcacaaagtctttgtctccatacctggacttgatggcacaacttattctaaaaggtcgcactcgctgtgtacaaatgtccggaaaagatttgaatcatgtaattgtcagtttaactattaaggaaatccaaaattgttttcaaaaccatataggttggcaaattgcctttgcagattacgtaggatcaatagataatcactatccaaaaaaccctgttttacaatttataaagcgtactcaatggattctgccaaaaaaggtgaaggagtcacccatcattgacgcccctgtgatctttactgatgggactagtaaagggaaggccggatatgtggctaatcaatctaaaattataagaacacctggcctttcagcccaacaggctgaactaactgctgtaatccatgccttgagggactatcctgagcctatcaatattctttctgattcagcatatgtagttcatgctgccaaaatgattgaagctgctaccattaaacaaaatttacctgtcttgttatttgacttgtttacaaaattacaaactgttgtaagggaaagaagatatccattttatattactcatatcagagcacatactaacctacctgggcctctagttgcaggaaataaagaaattgactgcttggtgacacctgtgttacaagaagctcaacattttcatgatttaacacatgtaaatgttcgaggccttaaaaaaagatttggaataacatgggctaaagctaagacaattgttcgtcaatgtcctgcatgtcaaattattaacaatccttctcaatctgagcctggagttaaccctagggggcttgtcccaaatgctctctggcaaatggatgttactcattattcatcttttggaaaattgtcatttattcatgtatgtattgatacttactctaaatttatttgggctactgcgcagtctggtgaatctgctaaacatgttattcgtcatttgtatgcctgttttgcagtcatgggcctgccacaagcaattaaaactgataatggtccagcttatatcagttctcaacttaaaacattcctagatacatggcatattgctcactctactggtctcccttacaacccccaaggacaggctattgtggaacgagccaatttatatgtaaaacaggctcttcaaaaacaaaaagggggagacacagaaatagttaagtcacaacaaacacttttaaacaaaaccttattcactttaaattttttaaacttggcctctgatgaaaaaacagctgcagagacatttttatacagaacaaaataagattaactttcctcatgctgaacagcccttgatttggtggcaggatccactaacaaatttctggtctccaggaaaacttattacgtggggtaggggatattcttgtatttcaccaggtcatggattacaacctgtttggattccatcaaggagaatcaaaccatatcatgagcaagcttgtgaagcatcccttgactccagaccccagaaggaggatgatgagggctcatcttcctcatcttcccacttgaggtcagatcaaacatctaacccgagaagctgaaaatctactaagaaaaggaaagcctctcactccaaataatttggtcctagctctctttactttggtttccatcgcagtgagtattctcacaactggcatagaaatcattttattacctgcatagtacagggattaaaagcctcatgagtaaaacccattaaaaactattgaaggtttaacaagagagtccatcagctttcttagcaagactcagaagggcattgagaaaacatacaaaggaacccagaaacaatggagggccaaataattcttaaggataaattcatagctcagccggtgccagatatatggagaaagctccaaaaaattggcttttggccctgatcaggatctggagcacctcctcagagtatgttataattggggccaggaagaatgaaaggagaacaagaagagagactgagaaaaggctgaggctctagttatggcgctacagggagtcaacctgggagaggactagggcagagacctatgcccggagtctgtttcctctgaggaaaagagggaccctttaaatgggaatgccccaagactcagatcactggaagagggattgcccctgaagatgaaggtctctgtggttgacccctcaggcccaggatcaagacttatggaacatttccataatggctcctgtccttgtcaccactcagccctaggtgactctaaatgtaggaatacagagccacttttcagtcctcctctccaatcctgggcccctccctcatgaatctgccacatttatatttctggcaagctggttacaaaattctttacacaacctttgagttgtgactgggaatccattttcttttctcaatacctttctgattgtttcagagtccaacttctcttttagaaattcttaaaatatggaaggtaactacatacatgttgttacagttgtcaacattaggtataatatattatcgtacctaggtttaacagaagtcaaatgagacactgaaacatcagttactaaacagaaactaaaggtctttagaatgattaaccaatatgatcagtaccaccctgaaatggtctctataagaaaaacttgtttttagaaattataaaagtcagtccgtggttgctttagaaaagtaggatatgagtgttttcaatatagaaggaatgaggaatggaattgcatcttattaaggtaaaagaaagtctgtcttcagctgattgctctccttggaaaataagggacagactaatatggatacagaaagtgatacaaggtgtgtgacaagtggacattgagaagagaattttgaacatggtggggaccgtttagaatatatctgagtaagttacctgtgctacataaggtagctgtccattgcatgctgaccaaggcatacaaatgtttcataaccagccagagaaatcagaagaatcatatgagttacctgtgttattataaaatctaaatgttgtattcctgattgttcacagaatgtgtctaattccctgctagatcatcaccaatagatccatgagctgtccaatccagctccagtttttggagctgccctgtggaaccagctgacctcctcttcctggtgaaaatatttctttgaggtatccaaagcaatgttatcaaagcccacttgaccattccatgagtggagacctaactgctttcccctaacgacgccccttttcagtaggaagaagttagagcggtcgtcgccccttttcccacagttagagtctccaactcaaagggggggaattaaggtagatttttaactcaggtagtcagtgtagggatatgggctttgatacattctttgtggctacttattaacatttgtaaactgagggtcgcatagcaagcccaactgctataaaggttgcgggtattgccccatggatccatcacatcagagtgaagaaggttgcatccgctgctgacatggacactggggaggctgtacagcacctcgagaatctcttcatggtcaagttccagagattcccttcgccatcatcagagtgctaagccctgctctggccacccttggaagttggtcagtctatgcacagcagaagcctgaggagttccacgtgagacttaaaacttgaactctgagacttaacttggactgtgttctaagcgaataattcaagaagtgaaaaaagtttcaagaactatttttgtcttcccgcaaaaacaaaaagggggagatgttgcaagatatgtttccttgaaaactccatcttgtccttctttactttatcctatcttcttgtcttactttatcccatcttccttcttggaaaaacagtcacagtgctggtaaatgacttaagcttaagagcaaagacctaaaggcataaatgacttaagcttaagaactgttatgtgcctagaggtcagagtaagagcttaaccctttaccacctaagtggctttttaaatagtaaaagaacttatataatagtaaaccctgtatgatccacccatagccactcctcacttaatctcacaataaaagcagtgtggtttcttgaggcagtgctcttggtccctgagatctggagttccccggtgctcttggtccctgagaccttgagtccctggctcccacctttacttaagataaatgtctctgtgtcttgttttatgttaactatttttccttaagttccacagcacccgttcttcccca

SEQ ID NO: 234 - DNA, 6965 bp, artificial
  ss2092 sequence
  misc_feature (3943)..(4042): n is a, c, g, or t
aagaagaaaaccttgtctccataggtgccacctatttttcaaggggaacctgaggactcaccccctatgccaccaccttatgtgctgccggccccacctccaggagccgaaggtccccagatgctagatagcccacagccttctgtttctcctcctccttctgcttctgaagttccccaggtgatatcacccctgcagccagattctccagaacctatgagcaggcatctcctgtcagctcagggagcagccactccagcattgcaaatgcccttacaggagacacggggaccacagcaagtcgcccccaatgggaccatacaagaggggggacgtttttagtattaccagcccttttccactgctgatctcctcaactggaaacaccatgctccttcatattctgaaaagcctcaggcactgattgatctcagaattcattttccagagacactgttccacctggatagactgctggcaactcctttttactctgtttgacactaaagagtgctggcaaattgtaacagaagcccaaaaatggcttcaggccaatgcggggggtcgagcagacttggcaaactgggtgagggaagtcttcccagaagaaaaccccaactgggactatgacactgaagaagggaaatgtaacctagagaggtaacggcaggccttcctacagggggcaaaagctgggctaaaaggcccactaatatagctaagatcagtgagatactacaagagccaaatgaaagtccagccaaattctatgagagactatgtgaggctttccgaatttacaccccttttgatcccgaggcccctgagaaccaacggatgataaatgttgcctttgtgggacaagcccaatcagatatctgtaaaaagctacagaaattagaaggatttgcaggagagaatgtcactaaactattggaaatagccaacaaggtttttattaaccgagaccaggtggcccgccatgatgcagaaaagagaatgaaactaaaagtgactcttctggcagccgccctgtcaaaaccggtgcccccagtgggaccaccccgtagggaacaaggcacaaagccagggaaaaggagtcccctggaacatgaccaatacacttactgcaaagaaaagggacattggaaaaatgaatgccccaaccgtcctgagaaaaagaccaaggccccacctagccggtactgatctgagccattcagcaccaacctgatcagcctagctgagtctgattaggggggaccaagctctctccaactggggtcccgagagcctatggtcagaattcaagtagagggccacccccatagactttatggttgacacaggtgccaaactttctgtggttacacaacctgtggctcccctctagaggaaggaaaccaccatcattggagccacaggtaaccaaacccacaggcccttctgcggtcctcgatgatgtcggttaggaggccatgaagtaatacatgaatttctttacctgcctgagtgcccagttcccctgatgggaagagacctgctggctaaaatggggacacaaatttccttttctactgatggatcggcccaacttaaattgacagaacccccctctcctttaatcatggctcttgctgtaaaagggaagaggaatggtgcttgtactcttccccttcagaaatgggggccattcccccagaactggagactaaatactcattggtttgggctgaaggaaacccaccaggactggcaaaatgccacgctcctgtcttgattgatctaaaacccggagctcaaccggtaaagctacggcaatactcaattcccagagaagctcaactgagaatccaggttcacctggataggctgcttcagcacggactgttaataaaatgtcagtccccttggaacacccctttactgcccgtgaaaaaaccgggaacacaggactactgcccagtacaggacttgagagccataaatgaagcaacagtcacattacacccatccgtccctaacccatataccctgctagggctgatcccctccactgctgagtggtttacttgcctggacttaaaagatgcctttttctgcctccgggtggcacctgccagtcagcccttgtttgcttttgaatgggaaaatccacatacagggacaaaggaacagctcacctggactagactcccacaaggattcaaaaactctccactctttttagcggcaccctagctgctgacctggctgaatttcctggacaaaaactgggctgtgttttgctacagtatgttgatgacctcttactggctggcaccatggaggctcagtgcctagaaggaacaagagctctcctttccctactgatggaggcagggtattgggtatcaaagaaaaaggcacaaatctgcaaaaaaacaagtcaagtatcggcttcaacatcatgcagggtcgacgaatgctggggactgaaagaaagcaggcagtttgtgccattcctgtccctaccacctgccggaaggttcctgagttcctaggggcagcaggattctgccggatatggatccccgggttttcagacttggccaggcctcagtatgaggctctaaaaggggaagaaaaggctccccttgaatggggaccaagccaggaggcagcatttcagacaatcaaaaccaaactcactgaggctccagccttgggacttcctgatataaccagagaatttaacatttttgttcatgaaaaaaaaaatgggatggctttaggagtcttaactcaaaaatttgggccttggcagaggccagtggcatatctgtctaaacaaattgacgcagttgcagctggatggcctccctgcctctgagcactggcagctaccaccttgttggtgagagaggctgacaagttgactctgggacaaaacaacctcaatgttaaagtcccacactcaattgtaaccctaatggataccaggggccaccattggctcacacatgcatgaatgactcaatatcaagggttactatgtgaaaatccatgggtaaaactggaggttgtacaaactctgaacccagctacttttctgccagatgaagcggggcccccagaccataactgcttggaggtactagatgagatgttttccagcaggtctgacttgactgataaaccactccaaaatcctgacctggttttatatactgatggcagcagctttgtggaggatggaaaaaggatggcaggatatgctgtggtatctgacttaaaagtgatagaagcagaggtgcttcctcaaggctggtcagcacagagggcagaattatgggccttaatcagagcactgggactcagtcgagaccagcgagttaatatctatactgactcaagatatgcccttgcaactttacatgtccatggagccttatataaagaaagaggactcctcactgctgaaggaaaagggattaaaaatcaggctgaaatcttaaagcttctagaggcagtatgggaacctaaagaagttgcagttatccactgtaaaggccaccaaaagggagacgacccagtgacaaaaggaaaccgtagtgctgatgcagctgccagacaggcagcccagggacaacaaccagacaaacctaaggtcttgctggccccagaagtgcctgctgtccccagatattctccagaggaagaaaaatgggtaagggaggaaggaggaactaaaactaaaacaggatggtgggtcacacaggaccaccaagtttatgttccagaacagcttgcctacaaactagtccaccaacaacacgagctaacccacatgggcaaaactgccttagagaccctactgggccagtactatctcattgctcgtcttcctgcactctgctcctctgtctcccaaagatgcataacctgtttacagaataatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacatctgttgatttctttgatatagtttaaagttctcagcatataggtctttacctccttggtcaggtgtattccgaggtatttgattttgtgaggtgcaattttaaaaggtatcgtatttttgtattccttctctaacagttcattgctggtatacagaaatgcgactgacttctgaatgtaaatcttatatcctgctactttgctgaattgattaatcagttcaagtagttttggggttgagtccttagggttttctatatatagtatcatgtcatctgcatacagtgacagtttgatctcttctcttcctatgtgggtgcctttgatttcttttgattgtctaatcgttgtgactacgacttccaaaattatgttgaagagcagtggtgagagtgggcatccctgtcttgttccagatttgagtgagaaggctttcagtttttccccattgaggattatatttgctgtgggtttatcataaatggctttgattatgttcaggaatgttccctctatacccactttggcgagggtcttgatcatgaatggatgttggactttgtcaaatgctttttctgcgtctattgagatgatcatatgatttttgacttttcttttgttaatgtggtgtacgacgttgattgatttgcatatgttgaaccaaccttgtgaacctgggatggaccctacctggtcatggtgtatggcctttttgatatgttgttggattcggttggctaagattttgttgagaatttttgcatctatattcatcaaagatattgggcgatagttttcttttttggtggtaactctgtctggttttggaatgacggtgatggtggcatcatagaatgtctttgggaatattccttcttcttcaaccttttgaaagagtttaaggaggatgggcaccagttcctctttatatgtttgatagaattcgtctgtgacttttatttgtaggcagtgttcttatgacgtcttcaatttcatttctagtgattggtctgttcagttggtgtgtttcttcttgattcaggtttgtcaggctgtaagattctagaaaactgtccatttcttccaggttgtcaaacttgttgccatatagttgttcatagtattctcttatggttttttgtatttctgcagtatctgttgtgattcgtcctttttcatttataattttgtttatttgggttctttctcttctcttttttagtgagtctggccaggggtttgtccattttgttgaccttttcaaagaacacagctaattttctctattgttttttgaatctctattttattgatttcctctttgatctttatgatttccttccttcttgctgactttaggtcttttttgttcttccttttctaattcgtttaggtggagggttaagttggtcaatttgggatctttcttcttttttgagaaaggcctctattgctataaatttccctctgagcactgctttcgcagcatcccatagattttgagaggttgtgtcttcattatcatttgtttcaaggtagtttttaatttccttcttgatttcctcattgacccctgggttttttagtagcatgttgtttagtctccatgtagtaggttttttctcatttcttttcccttggttgatttctaatttcctggccttgtggtcagagaagatacttgagataatttctatgctcctaaatttgttgaggctagctttgtgacccaatatgtggtcaattcttgagaatgttccatgtgcacttgagaagaatgtgtattctgatttttttggatgtagtgtcctgaagatgtcaattaagtctaacttttctattgtgtcctttaggatctctgtagctttattggttttctgtctagaggatctgtccattggtgtgaggggggtattaaggtctcctactatgattgtattcccatcaatttctccctttatgtctgttaatatttgttgtatgtatctgggtgctcctgtatttggggcatacatgttgacgatagtaacatcctctccttgggtggatcccttaatcattaagtagtgtccttctttgtctttctttatgtcttttgttttaaagtctattttgtctgatatgggtgttgtgactcctgctttcctgtcatgtctattggcgtgaaatattttttcccaccctttcactttcaatctatatgtctcctttgtcctaaggtgagtttcttgtaggcagcagattgaaggtttttgcctttttatccactcagccactctgtgtcttttgattggagcattcagtccattgacatttaaggtgataattgatagatcattatttattgccattttgaacctcatgttccagttgattctatggatctccattcttcctttctttttttggttggatggtctccggttattatctgtttgagtgttggtttttttttttttttatttccattttttgcgaatgcaatatttggttttggcttgtggttgccctgttttttaagtatgctaacccgttcctataattgtgtgttttagcctgatggtcctgtacgttcaaacactccattactatattaaaattaagaagagaaacaaacaaacaacaaaaaatggtctatttatttcctaacatcccttgtccacattttatgattttgatgactctttttttttctttttaattttattttgtttgaagcatgttcatgagtaaatctgtatgctggcttatttgagagactgctctctgattgtggattcctcagtcctagctcttcctcttctctctctctctttttttttattctttgtcctccctttctttccttcctttctttttggtttagagaagtcctctcagtatttcttttagcctgggttttgtattgctgtattctt

SEQ ID NO: 235 - DNA, 7062 bp, artificial
  ss2099 sequence
tgcttctgtaaccttgcttgctcagtctcttagggaggaacactgtctgcttggggatgggggaggtccgggatgcttacatgggaaaatccagaccttgtagtgtataaaagttactgagaacaaagacctggtgctcagactctggaggtgactcctctgagcccgcgccagtgctgaataaaccttgcttttccgtatctccgagtgctgtttgtctccttccgttgccacagtttttgcggtttccacaacattttggtgcgttggccgggaagctgacaaccgagctggcctcttgtgccaccgttgtcggggaactgggggaggccacggtcgccggcccggtgacaggtggatagcgcgcactggccatttttctggatccagaccctcactagggccgtggccttggcccacaccacttcccgaacggactcaaaggagagtggaaataggttccaggacaggacgtcggactggtgagtgccccggggacatctgcccaagtcaggacccgccatatggtggaaggagagactgatcacctctcagtgaccaaagggtcactcaggtcagggtttgctcccttgggatcgggaggcttgtcaattctggtgtgtgtgtgtgagtgactggagagaatgagagcccgtgctccaccgtctttggactacggagccagagtgagtcctaacctgcagttccgtggcgaccttcatatggcttatggtggccctcttcagggggatcctgatgttggggtttatacagtcccacctatgctaagaggtgcctgaaatatctcctccgggggagtggtcaggcggacgaagcgattgttacctgaggccttgccctcactgtttgtcttgcatcaccggcacagggtgggactttacacaatgggtaaattagcttccaagcccactgtcttagagtatatggttaaaaattttaagaaaggattttctagagattatggtgttaagctgagtcctggaaaactgtgtaccctctgtaccctagagtggccctcctttggtgttggctggcctccggaagggaccttagatgtgttcacagttacagcagtatataatgttataacaggagaccctggacacccagacccatttccgtatattgatcaatggttgaaaattgcctatttgaggcccccatgggttcggttctgcaccacagaccagggacagtgtagggtgctagtagcccagtccaagaagaaaaccttgtctcaaaaaaaggtgccacctatttatcaaggacaacctgaggcctcgccccctattccaccaccttatgtgctgccgaccccacctccaggagccgaaggtccccagatgccagatagcccaccgccttctgtttctcctcttccttctgcttctgaagttccctaagtgatatcacccccgcagccagattctccagaacctatgagcaggcgtctctggtcagctcagggagcagccactccagcattgcaaatgcccttacgggagacacgggaaccacagcaagtcatccccgatgggaccatacaagaggggggacgtttttattattaccagcgcttttccactgctgatctcctcaactggaaacaccatactccctcatattctgaaaagcctcaggtgctgattgatctcttagaattcattttccagacacactgtcccacctggatagactgcaggcaactcctttttactctatttgacactaaagagcgctggcaaattgtaacagaagcagaaaaatggcttcaggccaatgcggggggtcgaacagacttggcaaactgggtgaggaaagccttcccagaagaaaacccccactgggactatgacactgaagaagggaaacgtaacctagagaggtaccagcaggccttcctacagggggcaaaagctggggctaaaaagcccactaatatagctaagatcagtgagatactacaagagccgaatgaaagcccagccaaattctatgagagactatgtgaggcttttcgaacctacaccccttttgattccgaggcccctgagaaccaacggatgataaatgctgcctttgtgggacaagcccaatcagatatccataaaaagctacagaaattagaaggctttgcaggagaaaatgccactaaactgttggaaatagccaacaaggtttttattaaccgagaccaggtggcccgctgtgatgcagaaaagagaatgaaacaaaaagtgactcttctggcagccgccctgtcaaaaccggtgcccccagtgggagcaccctgtaggggacaaagcacaaggccagggaaaaggagtcccctggaacatgaccaatgtgcttactgcaaagaaaagggacattggaaaaatgaatgccccaactgtcctgagaaaaagaccaaggccccacctagccggtacccatctgagccattcagcaccaactggatcggcctagctgaatctgattaggggggaccaggctctctccaattgggcccccgagagcctatcgtcagaattcaagtagggggccaccccatagactttatggttgacacaggtgctgaactttctgtggttacacaacctgtggctcccctctcggggaaagaaaccaccattgttggggccacaggtaaccaaacccacacacccttctgcggtcctcgacgatgttggttaggaggccatgaagtaatacatgattttctttacctgcctgactgcccagtcaccctgatgggaagagacctgctggctaaaatggggacacaaatttccttttctactgatggatcggcccaacttaaattgacagaacccccctctcctttaatcatggctgttgctataaaaagagaagaggaatggtgcttgtactcttcctcttcagaaatggggaccgttcccccagaactagagactaaatacccattggtttgggctgaaggaaacccaccaggactggcaaaatgccacgctcctgtcttaattgatctaaaacccggagctcaaccagtaaagctacggcaatactcaattcccagagaagctcgactgagaatccaggttcacctggataggctgcttcagcatggactgttaataaaatatcagtccccttggaacacccctttactgcccgtgaaaaaatcaggaacacaggactaccgcccagtacaggacttgagagccataaatgaagcaacagtcacattacacccgtccgtccctaacccatataccctgctagagctgatcccctccactgctgagtggtttacttgcctggacttaaaagatgcttttttctgcctctgggtggcacctgccagtcagcccttgtttgcttttaaatgggagaatccacatacagggacaaaggaacagctcacttggactagactcccacaaggattcaaaaactctcccactctttttagcggtgccttagctgctgacctggctgaatttcctggacaaaaactgggctgtgttttgctacagtatgttgacgacctcttactagctggcatcacggaggctcagtgcctagaggaaacaagagctctcctttccctactgatggaggcagggtatcgggtatcaaagaaaaaggcacaaatctgcaaaaaaaacaagtcaagtatctgggcttcaacatcatgcagggccgacgaatgctggggactgaaagaaagcaggcagtttgtgccattcctgtccctaccacccgccggaaggttcgtgagttcctaggggcagcaggattctgtcggatatggatccctgggttttcagacctggccaggcctctgtatgaggctctaaaaggggaagaaaaggctccccttaaatggggaccaagccaggagacagcgtttcagacaatcaaaaccaaactcactgaggctccagccttgggagttcctaatgtaaccagagaatttaacctttttgttcatgagaaaaatggcatggctttgggagtcttaactcaagaatttgggccttagcagaagccagtggcatatctgtctaaacaaattgactcagttgctgccggatggcctccctgcctccgagtgctggcagctaccaccttgttggtaagagaggctgacaagttgaccctgggacaaaacctcaatgttaaagtcccacactcagttgtaaccctaatggataccaggggccaccattggctcacacatgcacaaatgactcaatatcaagggttactatgtgaaaatccacaggtaaaactggaggttgtacgaactctgaacccagccacctttctgccagatgaagaggggcccccagaccataactgcctggaagatgggtagaggccttccctacccgaactgaaaagacaagggaagtaaccaaggcactcctgagagacattattcccagatatggaatgcctctctgaccattgggtcagataatggacaggcatttgtggccgaaacagtacatcaggtggcaaaagctttacagatccgaaggaaactacactctgcttattgccctcaaagttcagggaaagtagaacgcatgaagcgaacccttaaacagaccctggcaaagttatgtcaggaaactggcttgccctggatagacatgttgacggtggccctctcaaaagtgagatgctcaccccgagcgggaataggattctcgccatttaaaatcttatatgaaaggccacctccactaatcagtttaaaaggaaacaccagggagttgggagacttggaattacacaaacaattacaaggactggggctcactatttctcggatacataaatgggtcacagacagaatacctgtgtccttaggtataacagtatacccccacaaggcgggggaccaggtgtggataaaggactggaaaaagaagcctttgaggccagaatggaagggcccctttactgtaattctaaccacccccactgctcttaaagtaacaggaatagatgcttggatccatcattctagagtaaaaccggctggcacagctgatgaccatggagagtgggagactgccctcgatccggagagacctcttcgcctgacaatagagagaaggagatgacaatctcaaagccctgctctgaccacaccggaagctggtcagtcaacgcacggctgaagcttgaggaatcggctgcctttgagcccaaatggaaggagagtttcaaaataaacattcacattgacggaagaggccttgaccctggagctgtgctacatttccagagaatcacgtttgtgctccaagctgcctctcacagggtctttcattccttttatgaagagataaaaaaacaccccacctcccattcccaccacaactaagaacttgttcttagccctggcagaaactattgcacaaactctcaaggttttctcttgttatgtatgtgggggaacaaacacaggagaccaccggccttggcaagccagaaaactggacccattagagcctcataatgagactgcatacccccaactcaccgatggggtatggctcctcaaaactgctactattgggaaaaattgtcttgcgaggtggggaggacggtctaatgtttcagttaaaagcctaacatgtttaggcctaaggtgttataatctaactgcccaaaagactcaatggtggtcatcctccaatctctcagagcccaaacctaatcccttgtctaacttttccctcctttgacaaacatgaaaagatatcagtgctgatatccagtggcgggcaccaaagggattatattggatttgtgaaaaaatggcctattccatactctcccccaattgggctggggcacgtgtactgggaacaatcagaccttccttcttcctgctcccgctgtcactaggggagcaactgggagttcctatatatagggcacagggtgcccagagagaccggaggactctccaaattggagactggaaagatgttgaatggcccccagaacagataattcaatattatgggcctgccacctgggcagaggatggctcttggggatatcgcatccctatctatatgctaaaccgcatcatcagactacaggcggttttggaacttataacaaatgacactgcaagggccttgactatattggcccaacaacaaactgaaatgcacagtgcaatctaccaaaatcgcttggccttggattatttacttgcttctgaaggaggggtttgtggaaaatttaacttaagtaattgctgtctacaaatagatgacaccgaaaaggtggtaaaaaaaattgctgaccgcataactaaacttgcccatgtacctgtacaaacttgaaaaggatgggatatagacagcctctttggtaaatggttctcttggttgggagaaattaagacaatggtcggaataatcatggttatactcacagggtgcctactttttccctgccttgtacctctcctgataaatattataaaaggttttataaaaaccatggttgaaaaaaaaacggcctcccacctgctacttatcagaggctaccaaagggttatgactgatgatgaactctaaagggtgcaaatgcaccctgaacatcaagaggggggaatgaaatagagttttaactaaagaacaaccccccttggctaagaaggcagctgcaggcctttccagctatgctcatcactataccacccttcttgtaataatgtaacaactgtgtgctctctgtccaagccagcagccctgctaatcaggtacccagcactgcttatcagttctgcttctgtaaccttgcttgctcagtctcttagggaggaacactgtctgcttggggatgggggaggtccgggatgcttacatgggaaaatccagaccttgtagtgtataaaagttactgagaacaaagacctggtgctcagactctggaggtgactcctctgagcccgcaccagtgctgaataaaccttgcttttccgtatctccgagtgctgtttgtctccttccgttgcca

SEQ ID NO: 236 - DNA, 8674 bp, artificial
  ss2104 sequence
tgtctgcttggggatgggggaggtctgggatgcttacatgggaaaatccagaccttgtagtgtataaaagttactgagaacaaagacctggtgctcagactctggaggtgactcctgtgagcccgcaccagtgctgaataaaccttgcttttccatatctccaagtgatgtttgtctccttccgttaccacagtttttgtggcttccacaacattttggtgcattggccgggaagccgacaaccgagctggcctcttgtgccactgttgtcagggatccaggggaggcaacggtcgctggccaggtgacaggtggatagtgcacaccagccattttgccagatccagaccctcactcgggccatgctggccttggcccacaccgcttcccaaacggactcagaggagagtggaaatgggttccaggacaggacatcagactggtgagtgccccggggacatctgcccaagtcaggacccgccatacggcggaaggagagactgatcacctctcagtgaccaaagggtcactcaggtcagggtttgctcccttgggattgggaggcttgtcaattctggtgtgtgtgtgtgtgtgtgagtgactggagagaacaagagcctgtgctccaccgtccttggactacagagccagagtgagttctaacctgcagttccgcggcgacctcatacggcttatggtggctctcttcagggggatcctgatgttggggtttgtttatacagtcccacctatgctaagaggcgtctgaaatatctcctctgggggagtggtcaggcggacgaagcgattgttacctgaggctttgccctcactgtcttgcgtcaccggcacagggtgggacttcacacaatgggtaaatcggcttccaagcccactgtcttagagtatatggttaagaattttaagaaaggattttctagagattatggtgttaagctgagtcctggaaaactgtgtaccctctaggccctagagtggccctcttttggtgttggctggcctccggaagggaccttagatgtgttcacagttacagcagtatataatgttatagcaggagaccctggacacccagaccaatttccatatattgatcaatggttggaaattgcctatttgaggcccccatgggtttggttctgcaccacagaccagggacagtgtaaggtgctagtagcccagtccaagaagaaaaccttgtctcaaaagaaggagccacctatttatcaaggggaacctgaggactcgcccccctatgccaccaccttatgtgctgccggccccacctccaggagccgaaggtccccagatgccagatagcccaccgccttctgtttctcctcctgcttctgcttctgaagttcctgaggtgatatcacccccacagccagattctccagaacctatgagcaggcgtctccattcagctcagggagcagacactccagcattacaaatgcccttacgggagacacacggggaccacagcaagtcgcccccgatgggaccatacaagaggggggacgtttttattattaccagcgcttttccactgctgatctcctcaactggaaacaccatactccctcatattctgaaaagcctcaggtgctgattgatctcttagaattcattttccagacacactgtcccccctgggtagactgctggcaactcctttttactctatttgacactgaagagcactggcgaattgtaacagaagcccaaaaatggcttcaggccaatgcggggggtcgagcagacttggcaaactgggtgagggaagccttcccagaaaaaaaccccactgggactatgacactggggaagggaaacgtaacctagggaggtgccggcaggccttcctacagggggcaaaagcgggggctaaaaagcccactaatatagctaagatcagtgagatactacagagccgaatgaaagcccagccaaattctatgagagactatgtgaggctttccaaacctacaccccttttgatcccgaggcccctgagaaccaacggatgataaatgctgcttttgtaggacaagcccaatcagatatccgtacaaagctacagaaattagaaggatttgcaggagagaatgccactaaactgttggaaatagccaacaaggtttttattaactgagaccaggtggcccgccgtgatgcagaaaagagaatgaaacaaaaagtgactcttctggcagctgctctgtcaaaaccggtgcccccagtgggaccaccctgtaggggactaggcacaaggccagggaaaaaggagtcccctggaacatgaccaatgtgcttactgcaaaggaaagggacattggaaaaatgattgccccaactgtcctgagaaaaagaccaaggccccacctagccggtacccatctgagccattcagcaccaacctgatcagcctagctgagtctgattaggggggaccaggctctctccaactgggcccccgagagcctatggtcagaattcaagtagggggccgccccatagactttatggttgacacaggtgccaaactttctgtggttacacaacctgtggctcccctctcggggaaagaaaccaccattgttggggccacaggtaaccaaacccacaggcccttctgtggtcctcaacgatgtcggttaggaggccatgaagtaatacatgaatttctttacctgcctgactgcccagtccccctgatgggaagagacctgctggctaaaatggggacacaaatttccttttctactgatggatcggcccaacttaaattgacagaacccccctctcctttaatcatggctgttgctataaaaagggaagagaaatggctcttgtactcttccccttcagaaatggggaccgttcccccagaactagagactaaatacccattggtttgggctgaaggaaacccaccaggactggcaaaacgccatgctcctgtcttaattgatctaaaacccggagctcaaccggtaaagctacggcaatactcaattcccagagaagctcgactggaaatccaggttcacctggataggctgcttcagcatggactgttaataaaatgtcagtccccttggaccacccctttactgcccatgaaaaaaaaatgggaacacaggactaccgcccagtacaggacttgagagccataaatgaagcaacagtcacattacacctgtccgtccctaacccatatacccttttagggctgatcccctccactgctgagtggtttacttgcctggacttaaaagacgctttttatctgcctccgggtggcacctgccagtcagcccttgtttgcttttgaatgggagaacccacatacagggacaaaggaacagctcacctggactagactcccacaaggattcaaaaactctcccactctttttagtggcaccttagctgctgacctggctgaatttcctggacaaaaactgggctgtgttttgctacagtatgttgacgacctcttactagctggcaccatggaggctcagtgcctagagggaacaagagctctcctttccctactgatggaggccgggtatcgggtatcaaaaaaaaaggcacaaatctgcaaaaaacaagtcaagtatctgggcttcaacatcatgcagggccgacgaatgctggggactgaaagaaagcaggcagtttgtgccattcctgtccctaccacccgccagaaggtttgtgagttcctaggggcagcaggattctgccggatatggatccccgggttttcagacctggccaggcctctgtatgaggctctaaaaggggaagaaaaggctccccttaaatggggaccaagccaggagacagcatttcagacaatcaaaaccaaactcactgaggctccagccttgggacttcctgatgtaaccagagaatttaaccttttgttcatgagaaaaatgggatggctttgggagtcttaactcaagaattggggccttgacagaggccagtggcatatctgtctaaacaaattgactcagttgctgccggatgccctccctgcctccgagcactggcagctaccaccttgttggtaagagaggctgacaagttgaccctgggtcaaaacctcaatgttaaagtctcacactcagttgtaaccctaatggataccaggggccaccattggctcacacatgcacgaatgactcaatatcaagggttactatgtgaaaatccatgagtaaaactggaggttatacaaactctgaactcagccacttttctgccagatgaagcggggcccccagaccataactgcctggaggtactagatgaggtgttttccagcaggcctgacttgactgataaaccactccaaaatcctgacctggttttatatactgatggcagcagctttatggaggatggaaaaaggatggcaggatatgctgtggtatctgacttaaaagtgatagaagcagaggtgcttcctcaaggctggtcagcacagagagaagaattatgggccttaatcagagcactggaactcagccaagaccagcgagttaatatctataccgattcacgatatgcctttgcaactttacatgtacatggagcttatataaagaaagagggctcctcactgctgaaggaaagggaattaaaaaccaggctgaaatcttaaagctcctagaggcagtatggaaacctaaagaagttgcagttatccactgtaaaggccaccaaaagtgggatgacccagtgacaaaaggaaaccgtagtgctgatacagctgccagacaggcagcccggggacaacagccagacaaacctaaggtcttgctggccccagaagtgccagctgtctccagatattctccagaggaagaaaaatggataagggaggaaggaggaactaaatctaaaatgggatggtgggtcacacgggaccaccgagtttacattccagaacagctggcctacaaactagtccaccaagagcataagctaacccacatgggcaaaactgccttggaaaccctactgggccggtactatctcattgctcatcttcctgcactctgctcctctgtctcccaaagatgcataacctgtttacagaataatgcctgccaggggccccacagaccagctggggcacaacactgtggactgtccccatttgaggatataaaagtggacttcactgaggtcacccctagtgaggggtacaaatatttactagtttttatctgtactttttcaggatgggtagaggccttccctacccgactaaaaaggcaagggaagtaagtaaccaaggcactcctgagagacattattcccagatatggaatgcctctgaccatcgggtcagataatggaccggcatttgtggctgaaacagtacaacaggtggcaaaagctttacagatccgatggaaactacattctgcatatcgccctcaaagttcagggaaagtagaacacatgaactgaacccttaaacagaccctggtaaagttatgtcaggaaactggcttgccctggatagacatgttgccggtggccctcttaaaagtgagatgctctccccgagcgggaataggattctcgccatttgaaatcttatatggaaggccacctccactaatcagtttaaaaggaaacaccagggagttgggagacttggaattacataaacaattacaaggactggggctcactatttctcggatacataaatgggtcacagacagaatacctgtgtccttaggtataacagtacacccccacaagccgggggaccaggtgtggataaaggactggaaaaaggagcctttgaggccggtatggaagggcccctatactgtaattctaaccaccccccactgctcttaaagtaacaggaatagatgcttggatccatcattctagagtaaaaccagctggcacagctgacgaccttggagagtgggagactgccctctatccggagagacctcttcacctgacaatacagagaagaagatgacgatctcaaagccctgctctgaccacaccggaagctggtcagtcaacgcacggctcaagcttgaggaatcggcagcctggtaaaataaactgccttacctcccttccacacgagactctctaactgccatatactgttatcttatgaccaacatgtatgtttgctgcctgttgctgttaatctggtcccctttggttctgtcaggatccatgtcctcatgtgacccgtacattcgagtgacccgatcagatcaaggggttacatggactttgctttactccactcatttctcctgttccggagaaattcatggaagttgtattcacaacaggaccacttattctgtcaacagggggaccaatatacttgctttgatccacgatactcaccaactgaagaatggttagaagtccggcgctctcataaatcagggcagctaattaatcgaacccaaattaccaaccccaagttgccaatatcaatattttttgatgcctgtgaagctatgaatgggtcatggacttctactagaccatgtggaagcccatcatggaaaagagaatataggctccagcataaatatatgtgctgggggaccacctggagtgattgcctggaatgcacttactggagctgtgtggcctgggcaacctggaataagggagacaaaacagctgtccttcaaaagggtacagcctctccagactgccagactaaagcttgtaacccagttaatttcactattttcaattccagtgagcccaaatggaaggagggtttcaaaataagcattcacattgacagaagaggccttgaccctggagctgtgctacatttccagagaatcacgtttgtgctccaagctgcctctcacagcatctttcattccttttatgaagagataagaaacaccccacctcccattccggccacaactaagaacttgttcttagccctggcagaaactattgcacaaactctcaaggtctcctcttgttatgtatgcgggggaacgaacacaggagaccactggccttggcaagccagagaactggacccattagagcctcataatgagactgcatacccccaactcaccaatggggtatggctcctcagaactgctattatagggaaaaattgtcttgcgaggtggggaggacagtttaatgtttcagttcgaggcctaacatgtttaggcctaaggtattataatctgactgcccgaaagactcaatggtggtcatcctccaatctctcagagcccaaacctaatccctgtctaacttttccctcctttgacaagcctgggaagatatcagtgctaatatccagtggcgggcaccaaagggattatattggatttgtgaaaaaatggcctattccatactccccccaaattaggctggggcatgtgtactggaaataatcagaccttccttcttcctgctcccactgtcactaggggaccaactgggggttcctatatatagggcacagggtgcccagagagactggagggctctccaaattggagactggaaagatgataaatggcccccagaacggataattcaatattatggacctgccccctgggcagagaatggctcttgggggtatcgcacccctatctatatgctgaaccgcatcatcagactacaggcggttttggaacttataacaaatgacactgcaagggccttgactatattggcccaacaacaaactaaaatgcacaatgcaatctaccaaaatcgcttggccttggattatttacttgcttctgaaggaggggtttgtgggaaatttaacttaagtaattgctgtctacaaatagatgacactggaaaggtggtagaagaaattgctgaccgcatgactaaacttgcccatgtatctgtacaaacttggaaaggatgagatgcagacagtctctttggtaaatggttctcttggttgggaggaattaagacaatggtcaaaatagtcagggttatactcacagggtgcctgcttgttccctgccttgtacctctcctgataaatattataaaaggttttataaaaaccatggttaaaagaaaaacagcctcccacctgctacttattagaggctatcaaagggttatgactcatgatgatctgtaaagggtgcagatgcaccctgaacatcaagaggggggaatgaaatggagttttaactaaagaacaacccccccccttggctaagaaggcagctgcaggcctttccagctgtgctaatcacgttaccacccttcttgtaataatgtaacaactgtgtgctccctctccaagccagcacccctgctctttaggtacccagcattgcttatcagttctgcttctgtaaccttgcttgctcagtttcttagggaggaacactgtctgcttggggatgggggaggtctgggatgcttacatgggaaaatccagaccttgtagtgtataaaagttactgagaacaaagacctggtgctcagactctggaggtgactcctttgagcccgcaccagtgctgaataaaccttgcttttccatatctccaagtgctgtttgtctccttccattaccacagtttttgcggtttccgca

SEQ ID NO: 237 - DNA, 8708 bp, artificial
  ss2106 sequence
tgtaaccttgcttgctcagtttcttagggaggaacactgtctgcttggggatgggggaggtctgggatgcttacatgggaaaatccagaccttgtagtgtataaaagttactgagaacaaagacctggtgctcagactctggaggtgactcctctgagcccgcaccagtgctgaataaaccttgcttttccatatctccgagtgctgtttgtctccttccgttgctatggtttttgcagtttctgcaacattttggtgcattggccgggaagtcgacaaccgagctagcctcttgtgccaccattgtcggggaaccaggggaggccacggtcgctggcccggtgacaggtggtggatagcgcgcacccgccattttgccggatccagaccctcactcgggccgtggccttggcccacaccgcttcccgaatggactcagaaggagagtggaaacaggttcctggacaggacgtcagactggtgagtgccccggggacatctgcccaagtcaggacccgccatacggcggaaggagagactgatcacctctcagtgaccaaagggtcactcaggtcagggtttgctcccttgggattgggaggcttgtcaattctggtgtgtgtgtgtgtgtgtgagtgactggagagaacaagagcctgtgctccaccgtccttggactacagagccagagtgagttctaacctgcagttccgcggcgacctcatacggcttatggtggccctcttcagggggatcctgatgttggggtttgtttatacagtcccacctatgctaagaggcgtctgaaatatctcctctgggggagtggtcaggcggacgaagcgattgttacctgaggctttgccctcactgtttgtcttgcgtcaccggcacagggtgggacttcacacaatgggtaaatcggcttccaagcccactgtcttagagtatatggttaagaattttaagaaaggattttctagagattatggtgttaagctgagtcctggaaaactgtgtaccctctaggccctagagtggccctcttttggtgttggctggcctccggaagggaccttagatgtgttcacagttacagcagtatataatgttatagcaggagaccctggacacccagaccaatttccatatattgatcaatggttggaaattgcctatttgaggcccccatgggtttggttctgcaccacagaccagggacagtgtaaggtgctagtagcccagtccaagaagaaaaccttgtctcaaaagaaggagccacctatttatcaaggggaacctgaggactcgcccccctatgccaccaccttatgtgctgccggccccacctccaggagccgaaggtccccagatgccagatagcccaccgccttctgtttctcctcctgcttctgcttctgaagttcctgaggtgatatcacccccacagccagattctccagaacctatgagcaggcgtctccattcagctcagggagcagacactccagcattacaaatgcccttacgggagacacacggggaccacagcaagtcgcccccgatgggaccatacaagaggggggacgtttttattattaccagcgcttttccactgctgatctcctcaactggaaacaccatactccctcatattctgaaaagcctcaggtgctgattgatctcttagaattcattttccagacacactgtcccccctgggtagactgctggcaactcctttttactctatttgacactgaagagcactggcgaattgtaacagaagcccaaaaatggcttcaggccaatgcggggggtcgagcagacttggcaaactgggtgagggaagccttcccagaaaaaaaccccactgggactatgacactggggaagggaaacgtaacctagggaggtgccggcaggccttcctacagggggcaaaagctggggctaaaaagcccactaatatagctaagatcagtgagatactacaagagccgaatgaaagcccagccaaattctatgagagactatgtgaggctttccaaacctacaccccttttgatcccgaggcccctgagaaccaacggatgataaatgctgcttttgtaggacaagcccaatcagatatccgtacaaagctacagaaattagaaggatttgcaggagagaatgccactaaactgttggaaatagccaacaaggtttttattaactgagaccaggtggcccgccgtgatgcagaaaagagaatgaaacaaaaagtgactcttctggcagctgctctgtcaaaaccggtgcccccagtgggaccaccctgtaggggactaggcacaaggccagggaaaaaggagtcccctggaacatgaccaatgtgcttactgcaaaggaaagggacattggaaaaatgattgccccaactgtcctgagaaaaagaccaaggccccacctagccggtacccatctgagccattcagcaccaacctgatcagcctagctgagtctgattaggggggaccaggctctctccaactgggcccccgagagcctatggtcagaattcaagtagggggccgccccatagactttatggttgacacaggtgccaaactttctgtggttacacaacctgtggctcccctctcggggaaagaaaccaccattgttggggccacaggtaaccaaacccacaggcccttctgtggtcctcaacgatgtcggttaggaggccatgaagtaatacatgaatttctttacctgcctgactgcccagtccccctgatgggaagagacctgctggctaaaatggggacacaaatttccttttctactgatggatcggcccaacttaaattgacagaacccccctctcctttaatcatggctgttgctataaaaagggaagagaaatggctcttgtactcttccccttcagaaatggcgaccgttcccccagaactagagactaaatacccattggtttgggctgaaggaaacccaccaggactggcaaaacgccatgctcctgtcttaattgatctaaaacccggagctcaaccggtaaagctacggcaatactcaattcccagagaagctcgactggaaatccaggttcacctggataggctgcttcagcatggactgttaataaaatgtcagtccccttggaccacccctttactgcccatgaaaaaaaaatgggaacacaggactaccgcccagtacaggacttgagagccataaatgaagcaacagtcacattacacctgtccgtccctaacccatatacccttttagggctgatcccctccactgctgagtggtttacttgcctggacttaaaagacgctttttatctgcctccgggtggcacctgccagtcagcccttgtttgcttttgaatgggagaacccacatacagggacaaaggaacagctcacctggactagactcccacaaggattcaaaaactctcccactctttttagtggcaccttagctgctgacctggctgaatttcctggacaaaaactgggctgtgttttgctacagtatgttgacgacctcttactagctggcaccatggaggctcagtgcctagagggaacaagagctctcctttccctactgatggaggccgggtatcgggtatcaaaaaaaaaggcacaaatctgcaaaaaacaagtcaagtatctgggcttcaacatcatgcagggccgacgaatgctggggactgaaagaaagcaggcagtttgtgccattcctgtccctaccacccgccagaaggtttgtgagttcctaggggcagcaggattctgccggatatggatccccgggttttcagacctggccaggcctctgtatgaggctctaaaaggggaagaaaaggctccccttaaatggggaccaagccaggagacagcatttcagacaatcaaaaccaaactcactgaggctccagccttgggacttcctgatgtaaccagagaatttaaccttttgttcatgagaaaaatgggatggctttgggagtcttaactcaagaattggggccttgacagaggccagtggcatatctgtctaaacaaattgactcagttgctgccggatgccctccctgcctccgagcactggcagctaccaccttgttggtaagagaggctgacaagttgaccctgggtcaaaacctcaatgttaaagtctcacactcagttgtaaccctaatggataccaggggccaccattggctcacacatgcacgaatgactcaatatcaagggttactatgtgaaaatccatgagtaaaactggaggttatacaaactctgaactcagccacttttctgccagatgaagcggggcccccagaccataactgcctggaggtactagatgaggtgttttccagcaggcctgacttgactgataaaccactccaaaatcctgacctggttttatatactgatggcagcagctttatggaggatggaaaaaggatggcaggatatgctgtggtatctgacttaaaagtgatagaagcagaggtgcttcctcaaggctggtcagcacagagagaagaattatgggccttaatcagagcactggaactcagccaagaccagcgagttaatatctataccgattcacgatatgcctttgcaactttacatgtacatggagcttatataaagaaagagggctcctcactgctgaaggaaagggaattaaaaaccaggctgaaatcttaaagctcctagaggcagtatggaaacctaaagaagttgcagttatccactgtaaaggccaccaaaagtgggatgacccagtgacaaaaggaaaccgtagtgctgatacagctgccagacaggcagcccggggacaacagccagacaaacctaaggtcttgctggccccagaagtgccagctgtctccagatattctccagaggaagaaaaatggataagggaggaaggaggaactaaatctaaaatgggatggtgggtcacacgggaccaccgagtttacattccagaacagctggcctacaaactagtccaccaagagcataagctaacccacatgggcaaaactgccttggaaaccctactgggccggtactatctcattgctcatcttcctgcactctgctcctctgtctcccaaagatgcataacctgtttacagaataatgcctgccaggggccccacagaccagctggggcacaacactgtggactgtccccatttgaggatataaaagtggacttcactgaggtcacccctagtgaggggtacaaatatttactagtttttatctgtactttttcaggatgggtagaggccttccctacccgactaaaaaggcaagggaagtaagtaaccaaggcactcctgagagacattattcccagatatggaatgcctctgaccatcgggtcagataatggaccggcatttgtggctgaaacagtacaacaggtggcaaaagctttacagatccgatggaaactacattctgcatatcgccctcaaagttcagggaaagtagaacacatgaactgaacccttaaacagaccctggtaaagttatgtcaggaaactggcttgccctggatagacatgttgccggtggccctcttaaaagtgagatgctctccccgagcgggaataggattctcgccatttgaaatcttatatggaaggccacctccactaatcagtttaaaaggaaacaccagggagttgggagacttggaattacataaacaattacaaggactggggctcactatttctcggatacataaatgggtcacagacagaatacctgtgtccttaggtataacagtacacccccacaagccgggggaccaggtgtggataaaggactggaaaaaggagcctttgaggccggtatggaagggcccctatactgtaattctaaccaccccccactgctcttaaagtaacaggaatagatgcttggatccatcattctagagtaaaaccagctggcacagctgacgaccttggagagtgggagactgccctctatccggagagacctcttcacctgacaatacagagaagaagatgacgatctcaaagccctgctctgaccacaccggaagctggtcagtcaacgcacggctcaagcttgaggaatcggcagcctggtaaaataaactgccttacctcccttccacacgagactctctaactgccatatactgttatcttatgaccaacatgtatgtttgctgcctgttgctgttaatctggtcccctttggttctgtcaggatccatgtcctcatgtgacccgtacattcgagtgacccgatcagatcaaggggttacatggactttgctttactccactcatttctcctgttccggagaaattcatggaagttgtattcacaacaggaccacttattctgtcaacagggggaccaatatacttgctttgatccacgatactcaccaactgaagaatggttagaagtccggcgctctcataaatcagggcagctaattaatcgaacccaaattaccaaccccaagttgccaatatcaatattttttgatgcctgtgaagctatgaatgggtcatggacttctactagaccatgtggaagcccatcatggaaaagagaatataggctccagcataaatatatgtgctgggggaccacctggagtgattgcctggaatgcacttactggagctgtgtggcctgggcaacctggaataagggagacaaaacagctgtccttcaaaagggtacagcctctccagactgccagactaaagcttgtaacccagttaatttcactattttcaattccagtgagcccaaatggaaggagggtttcaaaataagcattcacattgacagaagaggccttgaccctggagctgtgctacatttccagagaatcacgtttgtgctccaagctgcctctcacagcatctttcattccttttatgaagagataagaaacaccccacctcccattccggccacaactaagaacttgttcttagccctggcagaaactattgcacaaactctcaaggtctcctcttgttatgtatgcgggggaacgaacacaggagaccactggccttggcaagccagagaactggacccattagagcctcataatgagactgcatacccccaactcaccaatggggtatggctcctcagaactgctattatagggaaaaattgtcttgcgaggtggggaggacagtttaatgtttcagttcgaggcctaacatgtttaggcctaaggtattataatctgactgcccgaaagactcaatggtggtcatcctccaatctctcagagcccaaacctaatccctgtctaacttttccctcctttgacaagcctgggaagatatcagtgctaatatccagtggcgggcaccaaagggattatattggatttgtgaaaaaatggcctattccatactccccccaaattaggctggggcatgtgtactggaaataatcagaccttccttcttcctgctcccactgtcactaggggaccaactgggggttcctatatatagggcacagggtgcccagagagactggagggctctccaaattggagactggaaagatgataaatggcccccagaacggataattcaatattatggacctgccccctgggcagagaatggctcttgggggtatcgcacccctatctatatgctgaaccgcatcatcagactacaggcggttttggaacttataacaaatgacactgcaagggccttgactatattggcccaacaacaaactaaaatgcacaatgcaatctaccaaaatcgcttggccttggattatttacttgcttctgaaggaggggtttgtgggaaatttaacttaagtaattgctgtctacaaatagatgacactggaaaggtggtagaagaaattgctgaccgcatgactaaacttgcccatgtatctgtacaaacttggaaaggatgagatgcagacagtctctttggtaaatggttctcttggttgggaggaattaagacaatggtcaaaatagtcagggttatactcacagggtgcctgcttgttccctgccttgtacctctcctgataaatattataaaaggttttataaaaaccatggttaaaagaaaaacagcctcccacctgctacttattagaggctatcaaagggttatgactcatgatgatctgtaaagggtgcagatgcaccctgaacatcaagaggggggaatgaaatggagttttaactaaagaacaacccccccccttggctaagaaggcagctgcaggcctttccagctgtgctaatcacgttaccacccttcttgtaataatgtaacaactgtgtgctccctctccaagccagcacccctgctctttaggtacccagcattgcttatcagttctgcttctgtaaccttgcttgctcagtttcttagggaggaacactgtctgcttggggatgggggaggtctgggatgcttacatgggaaaatccagaccttgtagtgtataaaagttactgagaacaaagacctggtgctcagactctggaggtgactcctttgagcccgcaccagtgctgaataaaccttgcttttccatatctccgagtgctgtttctctccttccgttgctatggtttttgca

SEQ ID NO: 238 - DNA, 8406 bp, artificial
  ss2112 sequence
tgacaatatgtctcccccacccagggacaggcacaaacatgtaactccagaacaacttaaaattaattggtccacaaagcgcgggctctcgaagctttgaattgactggtttgtgatattttaaaatgattagtttgtaaaagcgcgggctttgttgtgaaccccataaaagctgtcccgactccacacttggggccgcagtcctctacccctgcgtggcgtacgactgtgggccccagcgcgctcggaataaaaatcctcttgctgtttgcatcaagaccgcttctcctgagtgatttggggtgtcgcctcttccgagtccggacgagagggattttcactcgactggcctttcatttggtgcgttggccgggaaacccgcgactacccctcacacccgagaaccgacttggaggtaaagggatcccctttggaacgtgtgagtgtgtgtgttggctggcgtctctgttctgagtgtctgttttcggtgatgcgcgctttcggtttgcagctgtcctctcagaccgtaaggactgggggactgtgatcagcagacgtgctaggaggatcacaggctgccgccctgggggacgccccgggaggtggggagagccagggacgcctggtggtctccttctgtcggtcagaggaccgagttctgttgttgaagcgaaagcttccccctccgcggccgtccgactcttttgcctgcttgtggaagacgcggacgggtcgcgtgtgtctggatctgttggtttctgttttgtgtgtctttgtcttgtgcgtccttgtctacagttttaatatgggacagacggtgacgacccctcttagtttgactctcgaccattggaatgaagttaaatccagggctcataatttgtcagttcaggttaagaagggaccttggcagaatttctgtgcctctgaatggccgacattcgatgttggatggccatcagaggggacctttaattctgagattatcctggctgttaaagcaattatttttcagactggacccggctctcatcccgatcaggagccctatatccttacatggcaagatttggcagaggatcctccgccatgggttaaaccatggctgaataaaccaagaaagccaggtccccgaattctggctcttggagagaaaaacaaacactcggctgaaaaagtcaagccatatcctcatatctaccccgagattgaggagctgctggcttggccggaaccccaatctgttcccccacccccttatctggcacagggtgctgtgaggggaccctctgcccctcctggagctccggcggtggagggacctgctgcagggactcggagccggaggggcgccaccctggagcggacagacgagatcgcaacattaccgctgcgcacgtacggccctcccataccggggggccaattgcagcccctccagtattggctcttttcttctgcagatctctataattggaaaactaaccatccccctttttcggaggatccccaacgcctcatggggttggtggagtcccttatgttctctcaccagcctacttgggatgattgtcaacagctgctgcagacactcttcacaaccgaggagtgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaacttggctaaggtaagagaggtgaagcagggaccgaatgaacctccctcggtttttcttgagaggctcatggaagccttcaggcggttcaccccttttgatcctacctcggaggcccagaaagcctcagtggccctggccttcataggacagtcagccctggatatcagaaagaagcttcagagactggaagggttacaggaggctgagttacgtgatctagtgaaggaggcagagaaagtgtattacaaaagggagacagaagaagaaagggaacaaagaaaagagagagaaagagaggaaagggaggaaagacgtaataaacggcaagagaagaatttgactaagatcttggccgcagtggttgaagggaaaagcaatagggaaagagagagagattttaggaaaattaggtcaggccctagacagtcagggaacctgggcaataggacctcactcgacaaggaccaatgtgcatattgtaaagaaaaaggacactgggtaagggactgccccaagaagggaaacaaaggactgaaggtcttagctctggaagaagataaagactagggaagacggggttcggaccccctccccgagcccagggtaactttaaaggtggaggggcaaccagttgagtttctggttgataccggagcgaaacattcagtgctactacagccattaggaaaactaaaagataaaaaatcctgggtgatgggtgccacagggcaacgacagtatccatggactacccgaagaacagttgacttgggggtgggacgggtaacccactcgtttctggtcatccctgagtgcccagcacccctcttaggtagagacttactgaccaagatgggagcacaaatttcttttgaacaaggaaaaccagaagtgtctgcaaataacaaacctatcactgtgttgaccctccaattagatgacgaatatcgactatattctcccctaggaaagcctgatcaaaatatacaattctggttggaacagtttccccaagcctgggcagaaaccgcagggatgggtttggcaaagcaagttcccccacaggttattcaactgaaggccagtgctacaccagtgtcagtcagacagtaccccttgagtaaagaagctcgagaaggaattcggccgcatgttcaaagattaatccaacagggcatcctagttcctgtccaatctccctggaatactcccctgctaccggttagaaagcctgggaccaatgactatcgaccagtacaggacttgagagaggtcaataaacgggtgcaggatatacacccaacagtcccgaacccttataacctcttgtgtgctctcccaccccaacggagctggtataaagtattggacttaaaggatgccttcttctgcctgagactacatcccactagccaaccactttttgccttcgaatggagagatccaggtgcgggaagaaccgggcagctcacctggacccgactgccccaagggttcaaaaactccccgaccatctttgacgaagccctacacagagacctggccaacttcaggatccaacacgctcaggtgaccctcctccagtacgtggatgacctgcttctggtgggagccaccaaacaggactgcttagaaggtacgaaagcactactgctggaattgtctgacctaggctacagagcctccgctaagaaggcccagatttgcaggagagaggtaacatacttggggtacagtttgcagggtgggcagcgatggctgacggaggcacggaagaaaactgtagtccagataccggccccaaccacagccaaacaagtgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtgactaaaccctttaccctttatgtggatgagcgtaagggagtagcccggggagttttaacccaaaccctaggaccatggaggagacctgttgcctacctgtcaaagaagctcgatcctgtagccagtggttggcccgtatgcctgaaggctatcgcagctgtggccatactggtcaaggacgctgacaaattgactttgggacagaatataactgtaatagccccccatgcattggagaacatcgttcggcagcccccagaccgatggatgaccaacgcccgcatgacccactatcaaagcctgcttctcacagagagggtcacgttcgctccaccagccgctctcaaccctgccactcttctgcctgaagagactgatgaatcagtgactcatgattgccatcaactattgattgaggagactggggtccgcaaggaccttacagacataccgctgactggagaagtgctaacctggttcactgacggaagcagctatgtggtggaaggtaagaggatggctggggtggcggtggtggacgggacccgcacgatctgggccagcagcctgccggaagggacttcagcacaaaaggctgagctcatggccctcacgcaagctttggggctggccgaagggaaatccataaacatttatacggacagcaggtatgcctttgcgactgtacacatacacggggccatctataagcaaagggggttgcttacctcagcagggagggaaataaagaacaaagaggaaattctaagcctattagaagccttacatttgccaaaaaggctagctattatacactgtcctggacatcagaaagccaaagatctcatatccagagggaaccagatggctgaccgggttgccaagcaggcagcccagggtgttaaccttctgcctataatagaaatgcccaaagccccagaacccggatgacagtacaccctagaagactggcaagagataaaaaagatagaccagttctctgagactccggaggggacctgctatacctcagatgggaaggaaatcctgccccacaaagaagggttagaatatgtccaacagatacatcgtctaacccacctaggaactaaacacctgcagcagttggtcagaacatccccttatcatgttctgaggctaccaggagtggctgactcggtggtgaaacattgtgtgccctgccagctggttaatgctaatccttccagaatacctccaggaaagagactaaggggaagccacccaggtgctcactgggaagtggacttcactgaggtaaagccggctaaatatggaaacaaatatctatcggtttttgtagacaccttttcaggatgggtagaggcttatcctactaagaaagagacttcaaccgtggtggctaagaaaatactggaggaaatttttccaagatttggaatacctaaggtaatagggtcagacaatggactagctttcgttgcccaggtaagtcagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccctatgaattgctctacggggacccccccccccccggtggcagaaattgcctttgcacatagtgctgatgtgctgctttcccagcctttgttctctaggctcaaggcgctcgagtgggtgaggcagcgagcgtggaagcagctccaggaggcctactcaggaggagacttgcaagttccacatcgcttccaagttggagattcagtctatgttagacgccaccgtgcaggaaacctcgagactcggtggaagggcccttatctcgtacttttgaccacaccaacggctgtaaaagttgaaggaatctccacctggatccatgcatcccacgttaagctggcgccacctcccgattcggggtggaaagccgaaaagactgaaaatccccttaagcttcgcctccatcgcgtggttccttactctgtcaataactcctcaagttaatggtaaacgccttgtggacagcccgaactcccataaacccttatctctcacctggttacttactgactccggtacaggtattaacattaacagcactcaaggggaggctcccttagggacctggtggcctgagttatatgtctgccttcgatcagtaatccctggtctcaatgaccaggccacacgccccgatgtactccgtgcttacgggttttatgtttgcccaggacccccaaataatgaagaatattgtggaaatcctcaggatttcttttgtaagcaatggagctgcataacttctaatgatgggaattggaaatggccagtctctcagcaagacagagtaagttactcttttgttaacaatcctaccagttataatcaatttaattatggccatgggagatggaaagattggcaacagcgggtacaaaaagatgtatgaaataagcaaataagctgtcattcgttagacctagattacttaaaaataagtttcactgaaaaaggaaaacaagaaaatattcaaaagtgggtaaatggtatgtcttggggaatagtgtactatggaggctctgggagaaagaaaggatctgttctgactattcgcctcagaatagaaactcagatggaacctctggttgctataggaccaaataagggtttggccgaacaaggacctccaatccaagaacagaggccatctcctaacccctctgattacaatacaacctctggatcagtccccactgagcctaacatcactattaaaacaggggcgaaactttttagcctcatccagggagcttttcaagctcttaactccactactccagaggctacctcttcttgttggctttgcttagcttcgggcccaccttactatgagggaatggctagaggagggaaattcaatgtgacaaaggaacatagagaccaatgtacatggggatcccaaaataagcttacccttactgaagtttctggaaaaggcacctgcatagggagggttcccccatcccaccaacacctttgtaaccacactgaagcctttaatcaaacctctgagagtcagtatctggtacctggttatgacaggtggtgggcatgtaatactggattaaccccttgtgtttccaccctggttttcaaccaaactaaagacttttgcgttatggtccaaattgtcccccgggtgtactactatcccgaaaaagcggtccttgatgaatatgactatagatataatcggccaaaaagagaacccatatccctgacactagctgtaatgctcggattgggagtggctgcaggcgtgggaacaggaacggctgccctaatcacaggaccacaacagctggagaaaggacttagtgacctacatcgaattgtaacggaagatctccaagccctagaaaaatctgtcagtaacctggaggaatccctaacctccttatctgaagtggttctacagaacagaagggggttagatctgttatttctaaaagaaggagggttatgtgtagccttaaaagaggaatgctgcttttatgtggatcattcaggagctatcagggactccatgagcaagctcagagaaaggttagaaaaacgtcacaaagaaaaagaggctggccaaggatggtttgagggatggttcaacaagtccccatgggtgaccaccctgctttctgctctaacaggacccctagtaatactgctcctgttgcttacagttgggccttgcttaattaatcggtttgttgcctttgttagagaacaagtgagtacagttcggatcatggtacttagacagcagtaccaaggccttccgagctaaggagaaactgacctttagccttcctagttctaagattagaactattaacaagagaagaagtggggaatgaaaggatgaaaatgcaacctgactctcccagaacccaggaagttaataagaagctctaaatgccctcgaattccagaccctgttccctataggtaaaagatcatactttttgctgttttagggcttgctttctgttctgtacaaaactatgtggaaggggaaaaacaggcccctgagtatgtgcctctatgcttgaaacttcttgaaactgctcctaactgcttgtttggcttctgtaaagctgcttgcataagataaaaagaggagaagttaatcgcctaaccggccccagtaagatcgggtgtgccacaaaatgttgaaaatcctgataaatatatcttggtgacaatatgtctcccccacccagggacaggcacaaacatgtaactccagaacaacttaaaattaattggtccacaaagcgcgggctctcgaagctttgaattgactggtttgtgatattttaaaatgattagtttgtaaaagcgcgggctttgttgtgaaccccataaaagctgtcccgactccaca

SEQ ID NO: 239 - DNA, 7385 bp, artificial
  ss2113 sequence
tgaaatggagttttaactaaaaaacaacccccccttggccaagaaggcagctgcaagcctttccagctgtgctcatcactatgccacccttcttgtaataatgtcacaactgtgtgctctctctccaagccagcacccctgctaatcaggtacccagcattccttatcagttccgcttctgtaaccttgcttgctcagtttcttagggaggaacactgtctgcttggggatgggggaggtccgggatgcttacatgggaaaatcaagaccttgtagtgtataaaagttactgagaacaaagacctggtgctcagactctggaggtgactcctctgagcctgcaccggtgctgaataaaccttgcttttccatatctccgagtgctgtttgtctccttctgttgccacggtttttgtggtttccgaaacattttggtgcattggcagggaagccaacaaccgagctggcctcttgtgccaccgttgtcagggaaccgggggaggccacggtcgctggccaggtgacaggtggatagcgcgcaccggccattttgccggatccagaccctcactcgggccatggccttggcccacaccgctccccgaacggactcagaaggaaagtggaaacaggttcctggacaggacgtcagactggtgagtgccctggggacatctgcccaagtcaggacccgccatatggcggaaggagagactgatcacctctcagtgaccaaagggtcactcaggtcagggtttgctcccttgggatcgggaggcttgtcaattctggtgtgtgtgtgtgtgtgtgtgtgtgtgtgtgtgtgtgtgagagagagtgactggagagaacgagagcccgtgctccaccgtctttggactacggagccagagtgagtcctaacctgcagttccgcagcgaccctcatatggcttatggtggccctctacggggggatcctgacgttggggtttatacagtcccacctatgctaagaggcacctgaaatatctcctctcggggagcggtcaggcggacgaagcgattgttacctgaggccttgccctcactctttgtcttgtgtcaccagcacagggtgggacttcacacaatgggtaaatcggcttccaagcccactgtcttagagtatatggttaagaattttaagaaaggattttctagaggttatggtgttaagctgagtcctggaaaactttgtaccctctgtaccctagagtggccctcctttggtgttggctggcctccagaagggaccttagatgtgttcacagttacaacagtatataatgttataacaggagaccctggacacccagaccaatttccacatattgataaatggttgaaaattgcctatttgaggcccccatgtgtttggttctgcaccacagaccagggacagtgtaaggtgctagtagcccagtccaagaagaaaaccttgtctcaaaagaaggtgccacctatttatcaaggggaaccagaggactcgccccctatgccaccaccttatgtgctgccggccccacctccaggagctgaaggtccccagatgccagatagcccaccaccttctgtttctcctcctccttctgcttctgaagttcccgaggccatatcacccccacagccagattctccagaacctatgagcaggcgtctctggtcagctcagggagcagccactccagcattacaaatgcccttacgggagacacggggaccacagcaagtcgcccccaatgggtccatacaagagaggggatgtttttattattaccatcccttttccactgccaatctcctcaactggaaacaccatactccctcatattctgaaaagcctcaggcgctgattgatctcttagaattcattttccagccacactgtcccacctggatagactgcctgcaactcctttttactctatttgacactgaagagtgctggcgaattgtaacagaagcccaaaaatggcttcaggccaatgcagggggtcaagcagacttggcaaactgggtgagggaagccttcccagaagaaaacccccactgggactatgacactgaggaagggaaacgtaacttagagaggtaccggcaggccttcctacaggggacaaaagctggggctaaaaacccactaatatagctaagatcagtgagatactataagagccgaatgaaagcccagccaaattctatgagagactatgtgaggctttccgaacctacaccccttttgatcccgaggctcctgagaaccaacggatgataaatgctgcctctgtgggacaagcccaatcagatatccgtaaaaagctacagaaattagaaggctttgcaggagagaatgccactaaactgttggaaatagccaacaaggtttttattaaccgagaccaggtggcccgccgtgatgcagaaaagagaataaaacaaaaagtgactcttctggcagctgccctgtcaaaactggtgcccccagtgggaccaccccgtaggggacaaggtacaaggacagggaaaaggagtcccctggaacatgaccaatgtgcttactgcaaagaaaagggacattggaaaaatgaatgccccaaccgtcctgagaaaaagaccaaggcccgacctagccggtacccatctgagccatgcagcaccaacctcattggcctagctgagtctgattaggggggaccaggctctctccaactgggcccccgagagcttatggtcagaattcaagtagggggccaccccatagactttatggttgacacaggtgccgaactatctgtggttacacaacctgtggctcccctctcggggaaagaaaccaccattgttggggccacaggtaaccaaacccacaggcccttctgcggtcctcgacgatgttggttaggaggccatgaagtaatacatgaatttctttacctgcctgactgcccagtccccctgatgggaagagatctgctggctaaaatgggggcacaaatttccttttctactgatggatcggaccaacttaaattgacagaaaacccctctcctttaatcatggctcttgctgtaaaaagggaagaggaatggtgcttgtactcttcctcttcagaaatggggaccattcccccagaactagagactaaatacccattggcttgggctgaaggaaacccaccaggactggcaaaatgccacgctcctgtcttgattgatctaaaacccggagctcaactggaaaagctatggcaatactcaattcccagagaagctcgactgggaatccaggttcacctggataggctgcttcagcatggactgttaataaaatgtcagtccccttggaacacccctttactgcccgtgaaaaaacagggaacacaggactactgcccagtataggacttgagagccataaatgaagcaacagtcacattacacttgtccgtccctaacccatataccctgctagggctgatcccctccactgctgagtggtttacttgcctggacttaaaagatgcttttttctgcctccaggtggcacctgccagtcagcccttgtttgcttttgaattggagaatccacatacagggtcaaaggaacagctcacctggactagactcccacaaggattcaaaaactctcccactctttttagcggcgccttagctgctgacctggctgaatttcctggacaaaaactgggctgtgttttgctacagtatgttgacaacctcttactagctggcaccacggaggctcagtgcctagagggaacaagagctctcctttccctactgatggaggcagggtatcgggtatcaaagaaaaaggcacaaatctgcaaaaaacaagtcaagtatctgggcttcaacatcatgcagggccgatgaatgctggggactgaaagaaagcaggcagtctgtgccattcctgtccctaccacccaccggaaggttcgtgagttcctaggggcagcaggattctgccggatatggatccctgggatttcagacctggccaggcctctgtatgaggctctaaaaggggaagaaatggctccccttgaatgggaaccaagccaggagacagcatttcagacaatcaaaaccaaactcactgaggctccaggcttgggacttcctgatgtaaccagagaatttaacctttttgttcatgagaaaaatgggatggctttgggagtcttaactcaagaatttgggccttggcagaggccagtgacatatctgtctaaacaaattgactcagttgcagccaaatggcctccctgtctccgagcgctggcagctaccaccttgttggtgagagttgctgacaagttgaccctggaacaaaatctcaatgttaaagtcccacactcagttgtaaccctaatggataccaggggccaccattggctcacacatacacgaatgactcaatatcaagggttactatgtgaaaatccacgggtaaaagtggaggttgtatgaagtctgaacccagccacttttctgccagataaagaggggcctcacagaccagctggggcacagcactgcggactgtccccatttgaggatatggaagtggacttcactgaggtcacccctagtaaggggtacaaatatttaatagtttttatctgtactttttcaggatgggtagaggccttccctacccgaactgaaaagacaaggaaagtaaccaagacactcctgagagacattattcccagatatggaatgcctctgaccatcgggtcagataatggactggcatttgtggccgaaacagtacaacaggtggcaaaagctttacagatccgatggaaactacattctgcttatcgccctcaaagttcagggaaagtagaatacatgaaccgaacccttaaatagaccctggcaaagttatgtcaggaaactggcttgccctggataagacatgttgccggtggccctcttaaaagtgagatgctcaccccgagcgggaataggattcttgccatttgaaatcttaaatggaaggccacctccactaatcagtttaaaaggaaacaccagggagttgggagagttaaaaattacataaacaattacaaggactggggctcactatttcttggatacataaatgggtcacagacagaatacctgtgtccttaggtataacagtacacccccacaagccgggggaccaggtgtggataaaagactggaaaaaggagcctttgaggccggtatggaagggcccctatactgtaattctaaccacccccactgctcttaaagtaacaggaatagatgcttggatccatcattctatagtaaaaccggctggcacagctgatgaccgtggagagtgggagactgccctcaatccagagagacctcttcgcctgacaatacagagaaggagacgacgatctcaaagccctgctctgaccacaccggaagctggtgagtcaatgcacggctgaagcttgaggaattggctgcctgtgagcccaaataaaaggagggtttcaaaataaacattctcattgacggaaaaggccttgaccctggagctgtgctacatttccagagaatcacatttgtgctccaagctgcctctcacagggtctttcattccttttatgaagagataaaaaaacaccccacctcccattccggtcacaactaagaacttgttcttagccctggcagaaactattgcacaaactctcaaggtctcctcttgttatgtatgcaggggaacgaacaggagaccattggccttagcaagccagaaaactggacccattagagcctcataatgagactgcatacccccaactcaccgatggggtatggctcctcaaaactgctattattgggaaaaaatgtcttacaaggtggggaggacagtttaatgtttcagttggaagcctaacatgtttaggcctaaggtattataatctgactgcccaaaagactcaatggtggtcatcctccaatcgctcagaacccaatcctaatcccttgtctaacttttcctcctttgaccagcatggaaagatatcaatactaatatccagtggtggcaccaaatggattatattggatttgtgaaaaaaatgacctattccatattcccccaaattgggctgggcatgtgtcctgggaacaatcaggccttccttcttcctgctcccgctgtcactaggagaccaactgggagttcctatatatagggcacagggtgcccagagagaccagaggactctccaaattggagactagaaagatgatgaatggcccccagaatggataattcaataatatgggcctgccacctgggcagaggatggctcttggggatatcgcacccctatctatatgctgaaccacatcatcagactacaggcggttttggaacttataacaaatgacactgcaagggccttgactatattggcccaaaaacaaactaaaatgcacagtgcaatctaccaaaatcgcttggccttggattatttgcttgcttctgaaggagaggtttgtggaaaatttaacttaagtaattgctgtctacaaatagatgacactggaaaggtggtagaaaaattgctgactgcatgactaaactagcccatgtacctgtacaaacttggaaaggatgggatacagacagtctctttggtaagtggttctcctggttgggaggaattaagacaatggtcggaatagtcatgattatactcgcagggtgcctacttgttccctgccttgtacctctcctgataaatattataaaaggctttataaaagccatggttaaaagaaaaacagcctcccacctcctacttattagaggctaccaaagggttatgactgatgatgatctttaaagggtgcagatgcaccctaaacgtcaagaggggggaattaaatggagttttaactaaaaaacaaaccctcccttggctagagaaggcagctgcaagcctttccagctgtgctcatcactatgccacccttcttgtaataatgtcacaactgtgtgctctctctccaagccagcacccctgctaatcaggtacccagcattccttatcagttccgcttctgtaaccttgcttgctcagtttcttagggaggaacactgtctgcttggggatggggaaggtccgggatgcttacatgggaaaatcaagactttgtagtgtataaaagttactgagaacaaagacctggtgctcagactctggaggtgactcctctgagcctgcactggtgctgaataaaccttgcttttccatatctctgagtgttgtttgtctcccgttgccacggtttttgcggtttccgcaaca

SEQ ID NO: 240 - DNA, 7874 bp, artificial
  ss2117 sequence
tgccacccttcttgtaataatgtaactgtgtgctctctgtccaagccagcagccctgctaatcaggtacccagcattccttatcagttctgcttctgtaaccttgcttgctcagtttcttagggaggaacactgtctgcttggggatgggggaggtccgggatgcttacatgggaaaatccagaccttgtagtgtataaaagttactgagaacaaagacctggtgctcagactctggaggtgactcctctgagcttgcaccggtgctgaataaaccttgcttttccatatctccgagtgctgtttgtctccttctgttgccacagtttttgcggtttccacaacattttggtgccttggccgggaagccgacaaccgagctggcctcttgtgccaccgttgtcggggaaccgggggaggctatggtggccagcctggtgacaggtggatagcgcgcactggccattttgtcggatccagaccctcacttgggccgtggccttggcccacaccgcttcccgaacggactcagaaggaaagtggaaacaggttcctggacaggacgtcagacttgtgagtgccccaggacatctgcccaagtcaggactcgccatacggcggaaggagagactgatcacctctcagtgaccaaagggtcactcaggtcagggtttgctcccttgggatcgggaggcttgtcaattctggttggtgtgtgtgtgtgagtgactggagagaacgagagcccgtgctgcaccgtctttggactacagagccagagtgagtcctaacctgcagttccgcggcgaccctcatatggcttatggtggccctctttggagggatcctgatgttggggtttatacagtcccacctatgctaagaggcgcctgaaatatctcctctgggggagcggtcaggcggatgaagcgattgttacctgaggccttgccctcactctttgtcttgtgtcaccggcacagggtgggacttcacacatgggtaaatcggcttccaagcccactgtcttagagtatatggttaagaattttaagaaaggattttctagaggttatggtgttaagctgagtcctggaaaactgtgtaccctctgtaccctagagtggccctcctttggtgttggctggcctccagaagggaccttagatgtgttcacagttacaacagtatataatgttataacaggagaccctggacacccagaccaatttccacatattgatcaatggttggaaattgcctatttgaggcccccatgggttcagttctgcaccacagaccagggacagtgtaaggtgctagtagcccagtccaagaagaaaaccttgtctcaaaagaaggtgccacctatttatcaaggggaacctgaggactcaccccctatgccaccaccttatgtgctgccggccccacctccaggagccgaaggtccccagatgccagatagcccaccgccttctgtttctcctcctgcttctgcttctgaagttcctgaggtgatatcacccccgcagccagattctccagaacctatgagcaggcgtctccattcagctcagggagcagccactccagcattacaaatgcccttacgggagacacggggaccacagcaagtcgcccccaatgggaccatacaagaggggggatgtttttattattaccatcccttttccactgccaatctcctcaactggaaacaccatactccctcatattctgaaaagcctcaggcgctgattgatctcttagaattcattttccagccacactgtcccacctggatagactgcctgcaactcctttttactctatttgacactgaagagtgctggcgaattgtaacagaagcccaaaaatggcttcaggccaatgcggggggtcaagcagacttggcaaactgggtgagggaagccttcccagaagaaaacccccactgggactatgacactgaggaagggaaacgtaacctagagaggtaccagcaggccttcctacaggggacaaaagctggggctaaaaagcccactaatatagctaagatcagtgagatactataagagccgaatgaaagcccagccaaattctatgagagactatgtgaggctttccgaacctacaccccttttgatcccgaggctcctgagaaccaacggatgataaatgctgcctctgtgggacaagcccaatcagatatccgtaaaaagctacagaaattagaaggctttgcaggagagaatgccactaaactgttggaaatagccaacaaggtttttattaactgagaccaggtggcccgccgtgatgcagaaaagagaataaaacaaaaagtgactcttctggcagctgccctgtcaaaactggtgcccccagtgggaccaccccgtaggggacaaggcacaaggacagggaaaaggagtcccctggaacatgaccaatgtgcttactgcaaagaaaagggacattggaaaaatgaatgccccaactgtcctgagaaaaagaccaaggcccgacctagctggtacccatctgagccattcagcaccaacctcattggcctagctgagtctgattaggggggaccaggctctctccaactgggcccccgagagcttatggtcagaattcaagtagggggccaccccatagactttatggttgacacaggtgccgaactatctgtggttacacaacctgtggctcccctctcggggaaagaaaccaccattgttggggccacaggtaaccaaacccacaggcccttctgcggtcctcgacgatgttggttaggagaccatgaagtaatacatgaatttctttacctgcctgactgcccagtccccctgatgggaagagatctgctggctaaaatgggggcacaaatttccttttctactgatggatcggaccaacttaaattgacagaaaacccctctcctttaatcatggctcttgctgtaaaaagggaagagaaatggtgcttgtactcttccccttcagaaatgaggatcattcccccagaactagagactaaatacccattggtttgggctgaaggaaacccaccaggactggcaaaatgccacgctcctgtcttaattgatctaaaacccggagctcaactggtaaagctatggcaatactcaattcccagagaagctcgactgggaatccaggttcacctggataggctgcttcagcatggactgttaataaaatgtcagtccccttggaacacccctttactgcccgtgaaaaaaaactgggaacacaggactacggcccagtacaggacttgagagccataaacgaaacaacagtcacattatacccgtctgtccctaacccgtataccctgctagggctgatcctctccactgctgagtggtttacttgcctggacttaaaagatgcttttttctgcctccgggtggcacctgccagtcagcccttgtttgcttttgaatgggaaaatccacatacagggacaaagaaacagctcacctggactagactcccacaaggattcaaaaactctcccactctttttagctgcgccctagccactgacctggctgaatttcctggacaaaaactgggctgtgttttgctacagtatgttgacgacctcttactagctggcaccacggaggctcagtgcctagagggaacaagagctctcctttccctactgatggaggcagggtatcaggtatcaaagaaaaaggcacaaatctgcaaaaaacaagtcaagtatctgggcttcaacatcatgcagggccgatgaatgctggggactgaaagaaagcaggcagtctgtgccattcctgtccctaccacccaccggaaggttcgtgagttcctaggggcagcaggattctgccagatatggatccctgggatttcagacctggccaggcctctgtatgaggctctaaaagaggaagaaaaggctccccttgaatggggatcaagccaggagacagcatttcagacaatcaaaaccaaactcactgaggctccaggcttgggacttcctgatataaccagagaatttaaccttttgttcatgagaaaaatgggatggctttgggagtcttaactcaagaatttgggccttggcagaggccagtggcatatctgtctaaacaaattgactcagttgcagccagatggcctccctgtctctgagcactggcagctaccaccttgttggtgagagttgctgacaagttgaccctggaacaaaatctcaatgttaaagtcccacactcagttgtaaccctaatggataccaggggccaccattggctcacacatacacgaatgactcaatatcaagggttactatgtgaaaatccacaggtaaaactggaggttgtacaaactctgaacccagccacctttctgccagatgaagcgggacccccagaccataactgcctggaggatgggtagacgccttccctacctgaactgaaaagacaagggaagtaaccaagacactcctgagagacattattcccagatatggaatgcctctgaccatcgggtcagataatggaccggcatttgtggccaaaacagtataacaggtgacaaaagctttacagatccgatggaaactacattccgcttatcgccctcaaagttcagggaaagtagaacgcatgaaccgaacccttaaatagaccctggcaaaattatgtcaggaaactggcttgccctggatagacatgttgccggtggccttcttaaaagtgagatgctcaccccaagcgggaataggattctcgccatttgaaatcttaaatggaaggccacctccactaatcagtttaaaaggaaacaccagggagttgggagagttaaaattacataaacaattacaaggactggggctcactatttctcagatacataaataggtcacagacaagaatacctgtgtccttgggtataacagtacacccccacaagccgggggaccaggtgtggataaaggactggaaaaaggagcctttgaggctggtatggaagggcccctatactgtaattctaaccacccccactgctcttaaagtaacaagaatagatgcttggatccatcattctatagtaaaaccggctggcacagctgacaaccgtggagagtgggagactgccctcaatccggagagacctcttcgcctgacaatacagagaaggagatgacgatctcagagccctgctctgaccacaccggaagctggtcagtcaacgcacggctgaagcttgagaaatcagcagcctggtaaaataaactgccttacctcccttccacaagagactctctgtcatatactgttatcttatgaccaacatgtatgtttgctgcctgttgctgttaatctggtcccctttggttctgccaggatccatgtcctcatgtgacccgtgcatttgagtgacccgatcagatcaaggggttacatggactttgctttactccactcatttctcctgttccagagaaattcatggaagttgtactcacaacaggaccacttattctatctgtcaacagggggaccaatatacttgctttgatccatgatactcaccaactgaagaatggttagaagtccggcgctctcataaatcagggcagctaattattcggacccaaattaccaaccccaagttgccagtatcaatactttttgatgcctgtgaagctatgaatggatcatggacttctactagaccatgtggaagcccatcatagaaaagaaaatataggctccagcataaatatatgtgctgggggaccacctggagcagttgcctggaatgcacttactggagctgtgtggcctgggcaacctggaataagggagacaaaacagctgtccttcaaaagggtacagcccctccagactgccagactagagcttgtaacccagttaatttcactattttcaatttcagtgagcccaaatggaaggagggtttcaaaataagcattcgcattgacaaaagaggccttgaccctggagctgtgctacgtttccagagaatcacgtttgtgctccaagctgcctctcacagcatctttcattccttttatgaagagataagaaacaccccacctcccattctggccacaactaagaacttgttcttagccctggcagaaactattgcacaaactctcaaggtctcctcttgttatgtatgcgggggaacgaacacaggagaccactggccttggcaagccagaaaactggacccattagagcctcataatgagactgcatacccccaactcaccaatgtggtatggctcctcagaactgctattatagggagaaattgtcttgcgaggcggggaggacggtttaatgtttcagttggaagcctaacatgtttaggcctaaggtattataatctgactgccctaaagactcaatggtggtcatcctccaatcactcagagcccaagcctaatcctttgtctaacttttcccaccttcgactagcatgggaagatatcagtactaatatccagtggcgggcaccaaagggattatattggatttgtggaaaaatggcctattccatacttctcccaaattgggctggggcatgtgtactgggaacaatcagaccttccttcttcctgctcccgctgtcactaggggagcaactgggagttcctatatatagggcacacgatgcccagagagaccggagggctctccaaattggagactggaaagatgttgaatggcccccagaatggataattcaatattatgggcctgccacctgggcagaggatggctcttggggatatcgcacccctatctatatgctgaaccgcatcatcagactacaggcggttttggaatttataacaaatgacactgcaagggccttgactatattggcccaaaaacaaactaaaatgcacagtgcaatctacaaaatcgcttggccttggattatttacttgcttctgaaggaggggtttgtggaaaatttaacttaagtaattgctgtctccaaatagatgacactggaaaggtggtagaagaaattgctgaccgcatgactaaactagcccatgtacctgtacaaacttggaaaggatgggatgcagacagtctctttggtaaatggttctcatggttgggaggaattaagacaatggtcagaataatcatgcttatactcgcagggtgcctatttgttccctgccttgtacctctcctgataaatattataaaaggttttataagaaccatggttaaaaaaacaaacaaataaacaaacaaacaaaaaaaacagcctcccacctgctacttattagaggctaccaaagcgttatgactgatgatgatctgtaaagggtgcaaatgcaccctgaacatcaagagggggaacgaaatggagttttaactaaagaacaacccccccttggccaagaaggcagctgcaagcctttccagctgtgctcatcactatgccacccttcttgtaataatgtaacaactgtgtgctctctgtccaagccagcagccctgctaatcaggtacccagcattccttatcagtttttgcttctgtaaccttgcttgctcagtttcttagggaggaacactgtctgcttggggatgggggaggtccgggatgcttacatgggaaaatccagaccttgtagtgtataaaagttactgagaacaaagacctggtgctcagactctggaggtgactcctctgagcttgcactggtgctgaataaaccttgcttttccatatctccgagtgctgtttgtctccttccgttgccacggtttttgcggtttccgca

SEQ ID NO: 241 - DNA, 7874 bp, artificial
  ss2118 sequence
tgatatcattaataaaataatcttgttattgcctatgcctattccttcccactaatcttatcacattccttaatcccactaataataatctcatcaccttccttaataaagtcgtgggataaatcctaggtgcctttgttctgtagaacagagagcctactggtcccccactttctaaatgtaaaagttttgtgcattttgttataccatgacgtccttcttccaggattctcctttgccctgaagtgctggacatggcagagtggtgcccaaagtggggctggaagaaaaggtatgccatgggtgaagaaataaggaaggtctgccacaagcaggaaaaggtgaaactacagatggaagagatggtagccttgcacttgatggagtcacgaccctgagtaggtaagtagaaactttaaaccaggataacaatggggcataataagtcacaggaaactaaacattatatccaattgcttaagtgtatgttgagactgtcagaggttcaggtaacagtctgagatagaggaattattagaagccatgatctaatataacccttggtttacaggtgatggtattgtggacctgtaatgttgagatctcatgggagaaaatttaaagcatgcccaatcagtctggggcttctctttctgtttctgtttttttctacatggagaccaataagacatgttctataactcttgcaggagtataaggaaagacctacaccttctgctccccctaaaactgatccctttcttgataagagtttaaataagcctttagctgtggaggcaacattaactccccttcaatcagccctaaaatctgcaagtctagaggatcatacctttttagcatgccctataacaattgcccctgatccacaagtcccaggataaaatatccatatgcataacacttttgattttaaagctcttaagtctctgtgggagagtgtaatacagaatggagctgcagctccttttactatgagtatggtaaaatcatggggacgcttcagcttcccccatgggattggcatatgatagtcaaagccaccctagatggtggagactatttaatttggaagtctagtcttccagattttttgtcaggaacaggctcgcttaaatgaatggaacaatgttccaattacttttgaaatgttggttggaacaggcccttttcttgactaagaaaaacaactgacttttgatcttctggcatatgagtaggtgagcctggccacccaaagagtatggatacaaattcctgagaggaaatccacaaggatcttttttgtaatgccttcaatgccctgcagagacttacccacagtttgtggaccaccaagtagcacattctcaggcagctgatattttaattagacaattggcatacaaaattgcaaataaagactgtaaaagggcaacggcccctttaagaaatttgggaggcatatctgattttattaaggtgtgtcaagatgtaggaagtatgggttatgctcaagcaatgcttgctgcagcattgaaaggaaggcttagcagctcaggaaagaaatgctttaattgtggaaatgcaggactttttcagaaaaaaatgtggagctcagttaaaagggaaataatccctagcaacaggattatctccaggacctagtcataaccctggtttatgtccttattgtcagaaaggaaatcattgggctaataaatatcagtctaagtttcaccaaaatggtactccattaacaactctggtgtcaggaaacagaaatcagggcctgcctcatcaccatcaaccaatgaaggcatttgtggctcaggacaatctgaggataggaaagagttgccagaaagaaaggggaacatagtatttggaagttcagggacttctcagatcttttggactcaggaattcacagctgagtatccacaaatgactcttaaggttaatggaaaaaatataaggagattaacaggtactgttataaggattggcatcccacatagcctttaattacccccaaaaaagttgaggggattaggagttaagactatagtccatcaaagtcagcagatgctttcctggatcagacagaccagaaggaaaaatgggttatcttaaaccttatgttgctgatatacccatcactttatggggaagagatcttctgtctactatgagacataaattaacaactgaggatgtctattgtggcaattctagtgattcttcccctggatggaaactaatgaaaaaattaggatatcaaaaataaacaggcttaggaaaaaacaaagtgtaaaagaacctataaacttgcccactaagcttacatgcaatagggttcactgagcatttcttaatagggaccattgaaaattctttgctagcccatgcagatcctatacaatgaattaatgatgatccaattttggtagatcagtggcccataactcaggagaaatggactaaaatacatgagcatttaatagctcagcagttgcaagcagggtatattgaggaaactaacagcccatggaataatcctatttttactattcctaaaaaatcaggtaaatggaggttatttcatgatataagagaaactaatgaaaaaaatgtattctatgggagccttacgaccaggcttgccttctcctactgcagttcccttaattgggctttaattgttatagatttaagggattgtttttttcaccataccattagccccccaagataaatgtagatttgctttctctgtttctgctttaaactacaaaacacttattaaatgacatcattagaaagtattgctagagtgcatgaaaaacagccctaccatgtgccaaaaatttgtggatcgagctttagctcctgttagacttaaatattctgaggcatatattattcattacatggatgatattcttctctctgctccaaaagaacaagtttttaaaatcttgctagataccaaagtatttcttaatgaaaaggggcttattatagccccagataaaattcaaaagacccctccatttcaatatttaggaactttgatagaagaccatactattcggccacagaaaatgcaaattcgcagggatcaattgaatacattaaatgattttcaaaaattattaggagatattaattttctgtggccttatttaggaattactaaaaatcaattaactcatatttttagaacatttaagggcaatcatgaccttacctccctacatacattgtctgctgcagccatcaaagaattacagctggttgagaaaaaaataaatgatgcacagttgcaactattgattatgataatattattattctgatcatgtcttctataaattcacctacaacagttctaattcaagaaatccgacagtttctcattgtcaagtggatccatctttctaatcaagaagtaaaaatggcaacagtttatgtggacctcatagctaagataattatccaaggcagacaccatcttaaacaattgattggagcagatccaaatgttatacatgtcccttgagacaaatttatgagagaaactttattccaaacatcattgttatgacagactgccttagctggatatcttgataatcatccacccaagataaacttatacaatttctatgagacttcttttatatttgcaaaagttaccagatcacagcctattgctaaagctcttacttattttacagacagattttcaaacagtaaagctggtattcaaattcaaatattactaaaattatacaaacttcttacatttcagtgcaaaaggtggaactagtggctgttcaacaagttttaaaaaaatcttgtatccttgtaatattaattcagattctcagtatgtggtacaaaaaactagaaacaacaaaattgaaagaaccaaatgatgaagagttattctatttttttgcacaaaacaaattattagacagagaacatcaccattttttattactcacatacgttctcatacatctttaccaggtcctttacatgatggtaatcaaaaggtggaccagcttataacttctgttttgaaaactgctgtgcttcacatgcacttctccatcaacccacagcagtgctgtgtagacagtttagtctgtatcatgctgttggccaagatattattaaatcttgtccatagtgtcaaagtttagcccaagtgtctaccaatgatggagtcaatcctagaggactgaaacctaatcatctatggcatatggatattactcatgttaatagttttggtcatttaaaatgtgttaatgttattgttgacacatattcctctattctttgggcctcagctcaagcaggtgagacagtgcatgtcaaaaaccatttgtttggaagcttttactgtttggggccttccacaatgtattaaaactgataatggtcctccttatgctagtaaggatttcgctgaattttgtcaaatttggggtatttcacacattactggcatcccttataatccccaaggacaagctatagtagaacatgcatatcataaattgaaactccaacttaaaaaacaaaaggggaaacaataaggatcctcccccacaagattattaagacaagctttgcttacttcaaattttttcacctataatgaacaaggaataaagcccatgaaatggcactatggccagcgtattcctggtacctgcccattagtatactggaaagcacctgaggaaaatatatggaaaagccatgacactttagtaacttggggaagagattatgcttgtgtctttccagaagcagcagctacacctttttggattcctggcaggtatgtgaaacagcggcatggaggaagaccaactgacactctttctgttgtgtaagtatggtattgccaaaatcataaaagagctttaattaattggcttaaaggaaattaagcagttacataaattatcaaaaaacataaagtaaattaatttttggttcacatgacctggaaaatattcagtattttatattcattattagatgttaatattaaagttagtttgttgatctgattaatatagacatatctttagtgtcatcaacattaagtataataccttattgtacctaggtttaatggaggaatgtaaccactttttattaagagaaaagagtctgtcttatagcttgtttttttgagtggacagatgggggacagagtaatatggatacagaaagtgatgaaatatttgtggaaagtggaaaatgagaaaagaattttgttcatggtttgggctaagtttaaaatttcattaaactaattttaaaggtaagctagtgcaaaacttgaatttaattcagtatctgttaaaagaatgttttcttaagtcagggctatgagaaatccaagacagccacttggttcttcccggctccctgacagtcccaataatgaaaaagaaatggtgagaaatgtgtttttttactttctacagtcctaatttggctgtatttggtaaaaatgagggtgattttaaagaaaaagtgtgctttgattcgtattctagttttctatattgagattaatgtttactgtttaaaactcacctccctaattgttttttgctgctatattacattattataaactttaactgaattattaagaaaaataatctaagtttgtttctgaagctgattgttgtaatctgtctctgggccaatatcagatgtcctgtgataaccaagggaatatatatacattctggaaatgtatcatttaaagtgttgtctctagtctagataaaaagtttcttatcaggagttcttatgtgccatatgaaggggtgaagaaaattaactcaaatatttatttctcacttaagaatgacttctgtattggactggtctatagagagaactactgaacttctaattcaccctaaaacaaggctctaacaagaaaaacactaatgcatggacaaaaagaagacagcatcagaagtagaccacttatcccaagattgtcacccctgactcatatggttatttgttttacttctgatttaccctggcagatttctcctctgaggctcttattattgctgttactagatgggatcccctcacctggctggttaatacctgctctgacccagaccataaatacattttcatctaataataacaggatggaagatcctaacttaattttttttattatgactttactaatactgctatctgtattttattaactgatttcaaaaaaaatgctatttcttgcattgctgaatttgtagctgagtttccgatgaaatgatatatagttccatatgaggtcagtgatctctatatatgggaaaatgcaacaagatggaatattttcctggaccataatagactaggaagataggtggaccagagacttttggctactgttaataagacctagtccagttatagcacattgacttgcctatcagtgaaatctttgccagatctaggaatattcattcctagaaccatcagatgaaatggccatgatatgcctcccaaaactatggttgaatatatgacgatgagcaagcactgtgaacagaagtttgacacttggcctcagccaagtggagtaaaacatgagtcactgcatctgctgacccacagcatcccttgagaagagctcagtgtggaaaccaggaatgaggcactctgtgctttgggaaaactgatagaacaggccttcagatggttagattttaggtaagcactttttttatgggcccaaattcttgcatcttctcatatctagaaaaagagaaatcatcatctacattggttattagtgagaaaaggcaaaatggagcagctgtgggtcagacatccaaggtaatatttggaaatactataagagtaattttagacaagtctttctattgctaagaacttaagttttatgtgccccatcagacttgatgccaccagctgttctcaaagcagcatcagctagcagctgcaaccttacattttaaaggtgtcctcttataacaacagaaaggagacaacatttataaggaccaatagctcctcctatttaaaactacactcctccttcagcagtactggtattaacctaaattccaaacctctttttaatctcatttttcttttcttcccattctcaatagaaggaacccacgatgtccagacccagtactcattgtccctagccagcaggaggtagctctagaagagaggaccataacccccatcccatatgaaaaataggctgtaataataggttcccaggaggatggagacagacccccacaccctgaatgtgactgttcaccttggagaccttctgtggacatggtctgagaaatcatggattgatctatagaaaactaatgaatgccctacaatcaaaatttacaatgatcatctttatgcaacaaataaataaaaaagggggatatgttggagaccatggaacagctgaactctggagaaggcaaatatctatggacgcagacatctaaagtacagagtctcccttaaaatcaagataaaggacttctatattaaccatgttattctataaacagctgcactatgtcctaaggataccccctttgatatcactaataaaataatcttgttattgcctatgcctattccttcccactaatcttgtcacattccttaatcccactaataataatcttatcacctcccttaataaaagtaatgtgggctaaatcctacatgcctttgttctgtggaacagagtgcctcctggtcccccactttctaaatgtaagagttttgtgtgttttgttatacca

SEQ ID NO: 242 - DNA, 9952 bp, artificial
  ss2124 sequence
tggtctgccaagcatggacccggaagaactagccaataaaagccttgtgaaacccctcttcggggctcagactccagagagtgagctcctctgaacccactggtgtaataaacctgagttccccaactctctgtgtgctcgcttggtttcttgctgggtaaaagagctgttggagctggtacactgaggccacagagctgtcagagctggtacactgcagccataaggctgccagcagagctgacacactctggccttgggatgctgacagccgccacaacatttctggaggccccagtgagattccaactgttctggccccttgtgccaccagagcagaggcaaggccacctgggacccggggagccttgaaccaaatgaggcagcatgccaccagacggtattccgggtcctcattcagagcagcattcctatctcccaggtgattgaaccccgaccagactccgtggagagggggagcaactcactggaaaggcgtccagacaaggaaaggccccagggccaaccccagtcaggtcctgccccagcaggcggaagaggggactgatcacccccttagagagactctcctggtcagaagctgtgcctgactggagcagtagtcctagtgctccagattggaagcagaggaacctcttgcttgggtggagcaactgtgaggaatagccgattgaaagttgtgcttgatggagctactggttagggactcccagggagtgggaggcattgtgataacctctgagtgcatgtgggagtgaatgagtgacctgattcatttgtgcttcaggttcaagtttgtggctccacagcctcagtggctatggagtctgagtgggtcctaatctgcagttccgtggtgacctcgtgtggctttcagctagagcaaactctgaggcttctcttccctccctgtgagttcaatccaagtccggggcttatatgaaccagccaatcgctaagaggcacctaaactcccgagaggggggcggtcaggcagacatctgaatggccaccttctgagaaggggtaccctcccttgttttgtctgtgacaccagcacagggtggccacatggagtgggagctaacctagaagcccatgagccagagacccctgtgctcctccaaggagataatctaacttgcccctgcccctgggcctccaggatctcccatcccagattctaaatgggctgcaggaccacccatttttttgcagctcatggaggcccagaatcagagtcggggagagtttcccaaatgttgagtgcagccccagttggaagttcctctattggaacatctatttttccacaagcccgtcatccccgtctcctgctacatcagttcatggtatagggaggttggggtatgaagtcacctgtcctttgcccaaaaattagaacttgtctgagagtgccttcctgaggcctagggccagatggatcagagacccttgcaaaaaagccggtgttctccccggctattgagtgagctgagtgggagctgttttgctttcaggagtggcagaggcagtgctccaggggataccactcatgaggatgaaagaggtctcataaaatcagatcataggtgagatccacagaaaagcaccatgggctcatccaaatcaaaaccctcaatcctagactgtacggtcaaaaattttaaaaaagagtttctcaggagacaatgggactgaaatgactccaggaaagctctgcactttgtgcgaactcaagctcgaatggccagcattcaatgtgggttggccttcagagggcactcttgatttatcaaaggtccaagcagtgtaccaagtagtcactgggacaccaggacatcctgatcgattcccatatattgactcttggctccagatttcttggatcttgcccccttgggtccagttctgcactaatgggaagggacagggtaggatttttgtggtccgaacatctggaaaggagaaaagtgagactactaagccaatcctccaaggagactcaggggatgaacccctgatgctcctgccatatgtatcaacacctcctccaccttcagctcagcctccacccaatcaccttccagaaagcccacctccatctgtgtccccaccacatcgaccactatggactctgagcccggagctggtaggcagatggctccaatctgctcagcaatctacccagccagctgcagctctccaagtgcccttgtgagaaattcagggcccccaacaagtgagtgaagatggttctgtacagctgggtcaggccattctcttctgccaactgttcagcacagccaatctcttaaattggagacaccacaccacagcatattctgagaagacgcaggccatgatcaacctcttggaatcggtcttccaaacccatcagccaacttgggatgatatccaccacctcctcctaaccctcttcaacaccagagagaggaggcacattttggctggggccaggaagtggccccaaggataggcccctgctggcaccgtttatatagaaggatgagcacaaactgcagcccctgaagctaagccagagtgggactttaacacactagaagaccagggtgtgctgcgctattactgtgatgccatcctacaggggctcagagctggggccaagaagccaatcaatatgtccaaaactaccatggtgattcaaaaggcagatgaggcaccaggggacttctatgagagactgtgtgaggctttctgaacctacactccctttgacccagaagcccctgaaaatatacagatggtcaatgctgccttcatggcccaattgtacacagatattcaacaaaagctccagcagctagaagggcttgctggaatgaacaccacccagctactagaggtggctaacaaggtttttgtgaattgagactaggaggaccattgagaagctgataaacagatgaagcagaaggcatccctgctagcagcagcactcggggggccagaccccagcaggcagcctgcaccaccacgcaaaggaggcatgagaagaagactaccgctaaaacaagatcaatgagcatcctgcaaggagatcggtcactggaagaatgagtgcccacagcgaaaggaggtaagagaccaactggggtaaagggccccatctgacaagaggaagtacaggcccgagccagtcacccatgaccttgtcagtctagccagaacagactctgattagggaagaccgggctccctgctcctgagcccctggagcccagtcaaggtgatggtggggggtcagcccataaaacttatggtggacatgtgtgcagagcattcagtggtggccacacccatgcccccccccccgagatgaaaagtgactattgcttgcggcacaggagcacaaacaaaccatccattttgctggccttggacctgtcaactttgagaccatctggtgacacatgagtccctgtatttgccagaatgtcccatccccttatttggaagagatctcctgactaatataggagcccaaataacattcacccctggggggccaactagcctaagcttcaaggataagggaaccttgctaatggcagttacagtacccagagaggatgaatggtgactctattgctcagagaagagctacacgaacctggaaagcctactagaagagttctctaaggaatgggcagagaaagggccttccccgggatggctaagaaccaggcacctatcacagtggacctgaaactcgggagcaccccagtcagacaaagacagtaccccgtcccccaggaagcacccctggggattcagaatcacatctgatgacttcaagatgctggaatattgatagactgtcaatcatcgtggaacacaccactactgccagtcaggaagtccaaaggtaaagattaccggccagtccaggatctgcaggcaatcgacaatgcagttgtcacaatacaccctgtagtgccaaatccctacactctcctccatctcctgcccactcaggccagctggttcacctgccttgaccttaagtatgccttcttctgcctccagctggcaccggtcagccagccattgtttgcttttgagtgggaggacctgctcacggggagaaagacacaattaacatggaccgaccagattaccgcaggtgttcaaaaactcaccgaccttgtttggggaagtactggccactgatcttgccacttttcccagagagattctgaactgtaactttctccagtacctggatgacttacctttagccagccccactagagaaggctgctgggcgggcacagaagccttactgactctgctctctgaggtgggctgtaaggtgtcctggaagaaggcccaaatatgcaagcagaaggtaaagtacctcatattcctcatctcaaagggcacaggctcttgggcctgagaggaaacaaacaatttgttcaataccttggcccaacacaaagaaagaggctcgggagttcctgggagctgcagggtttcgctgaatctggataccaggattctcaggcatagaaaagtcccctgtatgaggccactgcagggtctggaaaggagtccttaaagtgggggccagaacaggagggagccttctgggaaataaaaagactgctaattggtgccccagtgctaggattaccagctgtgacacgggacttcaacctctttgttcatgaaaagaaccatacagctctgggaatcctcacacagagtgttggaccatggaagcagccagtggcctacttgcccaagcatctagatccggtgatggcaggatggcccccatgtttccgaggcctggcagccacagtagccctaatcagagaagcagacaagcttaccctgggacaaaatataaccatgaaaattcctcatgcagttataacccctaatgagcagccaaggtcataagtggctgacccacacccggatgacatgactctcagcggctgctctgccaaaaccctcgagtacatctggagactgtgcagacactgaatctggccacttccctgcctactgaggtgggcccgcttgaccatgactgcaaagagaccatagacaaagtttattcgagttggccagacctaacagacattcccttcttggacccagaactcgatttttatatggatggaagcagctttgtccaaggaggacaatgtaaagcaaggtgtgctctaactacaacagagaaggtaataaaggctgaagctctcccacagggctggttggcacagcaggctgaagtgttggcattagtccaggcattgaggtatgctgaagggaaaagagtcaatatctacacagactccaagtatgcatttgccatgttacacattcatggggccatctataaggaaagaggactgcgcacagcaggagggaaagagataaagaacaaagaagaaatcctccagcttttggaggcagcagtcatccactgcaaaggccatcagaaggggaaagaccccatcagcaaaggaaatcaactggctggtcaggcagctaaggaggctgccggccagtgggtccctgaatgggaaccatccctaagatcctgttggcaccagaactgccccctgctcccaattatactaaagaagaggatcaatgggcccccaccagaaggagggaaaaaggagagggaaggctggtggaggctactggatcagacttttcatccccagtacaacaatggcccagttagtaacacagtaccatctgggaaaaactgccttagaaagcctactaaatcattattaccttatagccaagctccccaccctatgcacccagatcagcctctgatgtgtggcttgtgcccagaacaatgccagtcaaaacctaggcccagtcctggggtacaagcaatagggacaatgccctttgaggacctggaagttgacttcactgaagtcagaccctgccagagccatcgatatctgctagtgcttgtatgcacatattcaggatgggtagatgtcgggagccataaggctgctccagtaaagaaagcaaagccacagtcggtacctgcatgaggcttgtctggttagcagagctacagaccagctgaagaaagaagaaggattgcggatgcgtgaggcttgtctggttagcagagctacagacaagctgaagaaagaagaaggattgcagagcaatcccttgaaagacatcagctccaggaaaataaaaatgatatcccctaaaaaatatgttaatctatttttctgtgtttatccttctttttctatctcctattcacagctttcttactgctaaagatttgccctgggtatgtaaaactcttgaaccaaaacagagtgaagttatttaaacaatgtaatggaaaaagcctttgttttggagtaacaatttatggcacctactttgtgagagtatacaggggaaacttatgatttcagtccctttacttaaaaagaagtttggggctgggaaaatgttgtttggcctataaattgctattttctataatagatatattttttaacagtgtcacttataactttcatcccttgtgggggcatttgttaatttttgggtataatactcctttctattgaaattgatggcttggaacttacgtaaatcagcacaataggttaaatgtttagcttgctggcgccaaataaatcgtggttttaaaaatgtcatgagcccaaggctttcatgtgttttgttaactacatacacctttagttaaagaatgttaggtatcatagtttattacttattaaagctttgttcttaatatacaatagaatagctactgttgttgaccttttaagaaaaatacggtgtgaaactttaagtttgtaatcttgaaggaaaatctaaagttgaaaggaacatgttttaactaaccttcttttttttttttgtatctcaggtggagggaacaaaagggctttaaataaaatgctaatgtcaaatcttacacaaaacctgattgtgatagggtataaaaactgatgcttttcatttaataaattgggtcatctgcagcatgcagctgaggagttggctccaattctttccgcgccgtttgtagcccatcctctcctttggcactccctggctgctggggctggacctcggcaggtagaggccttccccacatgagtggaatgagcctgggaagtggctaaggttttgctgagggaaataatccccagatatgggctacccctcatgattggatctgataacaggcctgcttttgtgttggaagtaacccagaccttgactaggactctggaaatcaaatggaaacttcatacagcttataggccacaaagttcaggaaaagttgagcgcatgagccagacccttaaaatcactctagccaagttgcaccaggagactcaattaccctgggtagatgtcctccccttagccctactccaaaaccgatgcacacccagatccatgggctacatcctctttgaaactctgtatggaatgccccctcctgtaatagggaaggtaaagggagatcccagacagatggccgacatggagatatcccaacacctccagaccatagggaaagtcctccactgcatctccagatagaccctagagagggcccctgttcccttaggcaactggatccaccctcatcaacctggggacatggtatgggttaaggactggaagaaggagccaatccagccagtctggatgggcccctacatggttgtattggctactccaactcctgtcaaagttgcaggtattgtcccgtggatccatcacaccagaataaagaaggctgctcctgccactgacagagacacccgggaagttgtctggcaccctgagaaccccctcaggatcacgttccagagacatttggcactggaggatgttgggccctgctctggtcacacccagaagctggccagtctacacatggccgaagcttgaagaatctacagccctgccccagccacatactggaagttggctggttcctgcaagtggaagccggaggaactccatgcaaacttgaactgaactcatgctctggtggggaatattggtaattgaaattgccatagccctcatatttggagtggggctacatgcaacatccccttccgaatggggacagggagcccggctgctcatctgtgtgatgtatctcctgactgccagtatactaggatccctgttcataataggtcagtgaaaaagattaagggaatcatagttctgttaacactcaccctgctgctcactccaggggtgacagattggaatgatgatctatggtatgggacaggattaacagatgataggctgcccagaaaccactacctggctggctacaatccagggctaggtggaatagattttgagtttgaagggtcgcatgaggggcttccaccgcttctgctgcaccaccaccacccccaccccaccccgccaataaagctaccccagctaaaactcaggcctctaagtcaaggtcttgacctgagccgaatgctgaatgtcatgcaccacctcttaaacatgaaaaatgctaaactgatgagggactgctggctctgtttacccatccaaaagcctcaacttattgccataccaataagtgtcatcaataccaccaggggaaaccaaagtcagtttgatccaacacaagaacctagactggtaggtgtacacatgcctctcaaggccccgtggtgtattcaaagtcttgggaaaatggtttaggtgggtaacttgacaaaatgtgacaatgttactaatgttgagaacttggattactccttgatcaatggggcttggtgtagaccccagatgggcctcttctttgaatgaggaaattatgctttccagggcctccctgctaactggacggggacctgcatgctagcctttgtcactcctcaaaaagatattgtccctggaaatcagtctcttatgttgcccatagagtcacatggcagaaccaagagagcaatataaattatccccttattagttggtttgggaatttcagcagggataggagcaggagtgggaggaatagcatcctccgctccttattatcatcaagaatacacagatgacatggaacaagtagccacttccctagtagccttacaggatcaggcagactctctggcagaagtggctcttcaaaacaggagagcactggacttactcactgcagaaagtgggggactttgcctgttcctcaatgaagaatgttgtttttacacaaacagatctggaatagtcagaaacatggctcaacaactaaaagaatgcatagcaaagagaagggaagaattagataactcctggttactaggagctgggtggcatggctcatgcctttggctgggcctctcctcatggtcttcatggctctcacatttggcccctgtatcctgaactgtcttgtccagttcatctcctcatgcctagaatctataaagctacaaatggtggtgacgtccgggctacctttatatcagcccctgggccaagaagaccagaaaggttgatgcttgctccaaaaatgtgaaaaagcatcaagaggggggcatgtaggggaaaacatcctgacaaaaagtagaaaggagggaccccggccatgatgactaagcaaaatctggccaatgccccctaacctggccaactacccctaaccaccccacccaaacacatacgcttctgtaagcttgcttctgcacctattactttgccagttctcactctggcccgccaagcacagacctggaagaactagcccataaaagccttgcaaaacccctctttggggctcagactccagagagcaatctcctctgagcccatgggcataataaacctgagttctcca

SEQ ID NO: 243 - DNA, 5895 bp, artificial
  ss2127 sequence
aaaagccccctcaaaacaccgatcagaagccccaaagcctgttttatctgaggaaccagaggaaattcccccaccttatgcaccattgtacactccactgccgccagtacttccagcagccaacgctgtactggaggtatctgcctccgctgagagcagcccctcccagactcatctatgacgttatcagtagcagcctctcccgagcctccagtgttaacctcgtatactctggccagaaggcaaccgaaaagccgagtcagcagggatggccccctctccaccacggtgccagggggccctgcagatgccactgagagagaccagagagcctgttaattttaatcaagagactcaaatttgaggaggccaatgtgtttttgtgtatcaacccttcacaccactgacctcttcaactggaaaaatcatactccctcctacaccgagaagccccaagctatgatagatctagtgcagtccatcattcaaacccacgagcctacctggactgattgctggcagattcttctaattctatttaacattgaagaatgacaccaaattattcaggcagctttaagatggctagaggaacacgccccagctgggatagcagatccccggacttacacctgggcccatttccctgaggaaaaatccccaatgggaccctaataatgtctggggatttcaaatgctggagcaccaccaagaggcttttttttaaacaacatgaaggaaaaaggctaaaaacacggcaaaaccccagaggtgctccaggggcccgatgagagcccaagttgattctgtgagaggctatgtgaggtgttccacctcaacactgccttcaacccagaagctgctgagaatcacctaaaggttaatgcagcctttgtcagtcaggctcagggagacatttggcacaaatttacaaaagttagagggcttagctagaatgacttccagccaactattaaggttgcaacaaagatgtgtgtcagccaggaccaagaatcccaaagagatgcagaccaaaaaatgaagaatatgaatctacttgctgctgttctggttgaccaattagaacactcccagagaggtgccccactgggccagggctgtagtcaaggaagaagccatctaggaggaccacctcacactgagatgagactgggacaataccaatgtgctcactgccacctagagggccactagagaagtgaatgccccagtggtcagaggattattatccaacttctgaatggagagaggagaggtagggtgatttggagatgatgccaaccagtgcagcaatcatatgaggcccctgagagtgattttgttggtccagatgctatggggaactatgaggaagactaggacagatcaggctccattctgttagaagcccatggtccaaaggaccatagcaggaccagccctttaacttcatgttggatacctgggcagaacattctgtggtgacttggccaccattgtgggagccattggcaactgaatctgtcacccttttctattaccccaatgatgcagtttgggtggccagtaaatcatacatgaattcctggtacctctacaattgccctgtggccttgaggggttgagactcattgggaaagatacaggcccagacaacttccacctcccatggccaaacagccctgaccctagggaagccaggggcaaagattatgactctcacgatcccctgagcaaaagaatggtgccactgcagtcttgtagggaggccacagcagagaccccagcttccttttaagcttcctgggtatgggctgaggatagtccctcggactaccctgaaacatacccacattagtggtagagctaaaaccaggggttgaacctgcctgctagacaatatttcattcccccagagcacaaatagggattcagaaacatctggagagacttctaaaatacggaattctctgacccttccagtcatcttgaaacatgcctctcctgcctgttcaaaaaccagagacagacgactaccagccagttcaagacctacaaaagtaaacccagccacccagttgtccctaatccccacactctctggggccttatccctgccgaggctgtattcacatgcctggatcacaaagatgccttcttctgcatctgcctggcccctcagagtcaaccaatttttgtcttccaatggaaaatccagagaatgatgtcaagggccagctgacctggactagattgcttcaaggattcaagaactctccaaccatctttgctgctgcattagtgtctgacttaaaggccttcccagcatggcagtatggctgtacggtgctccagtatgttgacgatttgctactggctggacaaactcaggagagttgtatggaagggacacatctgctccttactctcctaagggacgctggctacaaggtttcaagggaaaaggcccagatctgtcaagaaaaaaataaataccttggctttcacatatcccagggacaacatcaactcagccctgagagaaaacaggctcaatcccagtttcgtccacctgacaccaggttcaggaatttcccagggctgcagatttctacaggatctgtatacccagcttctccattttagccatgcccatttatgaggtcacaaagggggaaaaacaagatcctttgttgtgggaatgagtacaacaaaaggccttttaaaaaaaaagcaagcaagccctcaccgacatacctggcttgggactcccaggcatggccaagcccttttccttgtacatacataagagcagtgatgttgcagtgggggtcttaactcagatgctgaggtcatggcatcatccaatgacatacttttccaaacaacctgactctggtacccaaggatggccacttggcagccacagcacttagttttggaagctgacaaattgatgatgggtcaaaaactaacagtctgagtgccacatttggtgttgacattggtggaatagaagggacaatactggctggccaatgcttggatggtcaaatatcagggaatgttatgtgaaaatctctgcattctcctggaggtggtaaggactctaaaccctacaccctgctgcctgtcaggctgggccagccagatcatgactgtgttgaagtcacagatgaagtattttccagtcaaccagatttaacagaccagcccttcaaagacccagatgctatttcactgatagtatcagctttgtaaaagagggagaatgtcttgctgggtattccatggtgaccctatgcattaaccagagcctccaactgtcatcagggatacatgtcagtatatattatgactccaaatatgccttcaccaccttccatgtacatgggctttatataaagagaaggggctaataaactcaggagggaaggacataaagtacagcaaggagatccctgaactcttagacagaggtggcagttatgcattgacagggaaatcaaaaaggggacactgtagtcactcggggaaaccataaagcagaccaggaagcaaaactcacagcctccaagggggcaatggaattggctttcctgatggccacactgttcacaagcttgctggcagaataggatctaaagtacagcatgaaatcacctagttccaaactaacaagggaaactacctcccaggggatggtggaaatttgaagatgaccaaattgcaattcctaaggccctggcctcagcctttgtcaagcagtttcatcaggagcctcacattggccagacagctgtggagactacattgggccgacacttctatctatatccttcagcttgccagcatggcccatgtagcatgtgaactctgtgagacatgtacccaaaataacctgtgtcaggggcctagggtcacccctgaaatacagaggggactcattcaaaaaagtagttgtggacttccttgagtttccctgaggccaaagctataaatatgtattagtctttgtgtacactttttcaggctgggtagaggtcttccctaaccaaacagagaaggcacatgaggtggctcaattcctcctgaaggaaatcgttccttgatttgggattccagtcaccattggattggacaacagaccaacatttgtggtgaaagtagtgtaattggtggcaaagggattaaaaatcgcctggaaggtggacacagcctattggctccagagctccagaaaggtgtaacggatgaattggactctgacactgcaattaagcaaactgtgctaggagatgcacctgcatcaggaccagctgttgccagtagccttgctaaaaattaggtccagccccagtaagtgaacagggttaaaaaatcctctatgggcattcccctcctctcattaagggtataaggggggacttaaaggaattagggaacctcaccctgaggcaagagatgcaggtgctacgttccaccctggccaccttctatcagtgagctaaggaatggttatttataagcctaaccacagatacccacctcttcaaaccaggggagctgaatgagtaaaagaatggaatggccaacccctttcaaggggcccatttactgtcattttatccaccactactgcagtaaaggtagcagaagtggctccttggatctgccgtagcagaataaaaccagcttcccaaggctggaaatacaattctgatccatcaacactgtccaacctgaccatccagaggaaacagattttgacacaacatacccttgaggacttcatccctgctttaatcactctggaagttgactaatctaagcatggcagaagcttgaggaataaatagactgattttatttcccatttcatttctcttactgtgatgcacggccaccccttatacctgtctgttattatgatccttgccctaacctggtcagggtcttgggtgataggatatatcggcccatctttcttcttgcttcaacttgtcagaggggaacatttgggtgtccaagtgtatgaggactgggagaccctagagaaaatggcgtgacctacaaattggcaactggaaagatgacaaatggcccccttagtgtatgtccattactatggtccagccacctgggcagaggatgggtcttatggatactgtactcccagctatatattaaattgcttattgggttacaggggttgttaaaatttttggggtggtgattttcaacttctaggtgattcaaaaccctcatagatgttgtgtttttaatttgaggggcttgcatgatcatactccatctagccccaagttgtaaggtttctctccagcttccttgaggccatggacaaagaaaacagcaccacacatgggatgctatggaaatataaacccttaaaccaagattatgctctttgaccccaaagagaatgtccaagcatcaaagcaggggatgtggtagaggccctcccagaacaaaaggaaggaacgtgaacaatcagcatctgtgcactcatgcacaactttgtggcagttatgacataatccatatccatgtgcaaatttttaacatagactatccatccaggatttacagaatatatgttatctcataagaggcacaaagggacaaaagtgtaaaagaaaaagataatggaggatgtataagacagcacctgtctatctttggagctcagcctctggatactaatctgctgagccagtgcctgcactaatgaatgctgcttcctggcaaaaagccttggtgtcttgtctctctgtactaagtcctacaatagtagaggttattccctgtgtagctagaatacccaacctggccttgaaaatgtggataaagactccaagggagggataggaaggt

SEQ ID NO: 244 - DNA, 9182 bp, artificial
  333034204_A sequence
tgtttacattattatttttgtggtgaagagaaggaatattcagtgctttggatcagtgcattaaacaaagagaaaggggtcttttcctctttgtttagaacttggatgttttgagcatgtgtcgtacacctggcagaagtctaagcaacccttctccatcctggcaggtgtgtgatacccagtggatggagctaaggaattttataaaactttttacccagagagagccatgtattgcatgaagcagcagggtgccctcaagaatcacgtgacctggcagaggcagcagtgtccatggcagtggccagtatccattggatgaggggcaggtcctgttggagcctcaaggtacttggtggtgaatgagtccacagtaggcttgaaaggatgaaaatgcaacctaaccctcccagaacccaggaagttaataaaaagctctaaatgcccccgaattccagaccctgctcgctgccagtaaataggtagaaggtcacacttcctattgttctagggcctgctatcctggcctaagtaagataacagggaatgagttgactaattgcttatctggattctgtaaaactgactagcaccatagaagaattgattacacatagaaagccctagtgacctatcttaaatcgctgcccggaagcctacgcagatgcggacctccggagctattttaaattgattggtccacggagcgcgggctttcgctattttaaattgattggtccacggatctcaatattttaaaatgattggtttgcgacgcacaggctttgttgtaaaccccataaaagctgtcccgaatccgcactcggggccgcagtcctctacccctgcgtggtgtatgactgtgggccccagcgcgcttggaataaaaatcctcttgctgtttgcatcaagaccgcttctcgtgagtgatttggggtgtcgcctcttccgagcccggacgagggggattgtacatttactggcctttcatttggtgcgttggccgggaagttctgcgaccaccccttacacccgagaaccgacttggaggtaaagggatcccctttggaacgtgtgtgtgtgtcggccggcgtttctgttctgagtgactgttttcggtgctgtgcgctttcggtttgcgctgtcctctcagaccgtaagaactggaggactgtgatcagcagacgtgctaggaggatcacaggctgccgccctgggggacgccccggtaggtggggagagccagggacgcctggtggtctccttctgtcggtcagaggaccgagttctgttgttgaagcgaaagcttccccctccgcggccgtccgactcttttgcctgcttgtggaagacgcggacgggtcgcgtgtgtctggatctgttggtttctgtttcgtgtgtctttgtcttgtgcgtccttgtctacagttttaatatgggacagacggtgacgaccccccttagtttgactctcgaccattggactgaagttaaatccagggctcataatttgtcagttcaggttaagaagggaccttggcagactttctgtgcctctgaatggccaacattcgatgttggatggccatcagaggggacctttaattctgaaattattctggctgttaaaacaattatttttcagactggacccggctctcatcctgatcaggagccctatattcttacgtggcaaaatttgacagaagatcctccgccatgggttaaaccatggctaaataaaccaagaaagccaggtccccgaatcctggctcttggagagaaaaacaagcactcggccaaaaaagtcgaaccctctcctcgtatctaccctgagatcgaggagctgccgacttggccggaaccccaacctgttcccccacccccttatccagcacagggtgctgcgaggggaccctctgcccctgctggagctctggtggcggagggacctgctgccgggactcgaagccggaggggggccaccccggagcggacagacgagatcgtgatgttaccgctgcgcacctatggccctcccatgccgggaggccgattgcagcccctccagtattggcccttttcttctgcagatctctataattggaaaactaaccatccccctttctcggaggatccccaatgcctcacggggttggtggagtcccttatgttctctcaccagcctacttgggatgattgtcaacagctgctgcagacactcttcacaactgaggagcgagagagaattctgttagaggctagaaaaaatgttcctggggccgacgggcgacccacgcagttgcaaaatgagattgacatgggatttcccttgactcgccccagttgggactacaacacggctgaaggtagggagagcttgaaaatctatcgccaggctctggtggcgggtctccggggcgcctcaagacggcccactaatttggctaaggtaagagaggtgatgcagggaccgaacgaacctccctcggtatttcttgagaggctcatggaagccttcaggcggtacaccccttttgatcctacctcggaggcccagaaagcctcagtggccctggccttcatagggcagtcggccctggatatcagaaagaaacttcagagactggaagggttacaggaggctgagttacgtgatctagtaaaagaagcagagaaggtgtattacagaagggagacagaagaggagaaggaacagaggaaagaaaaggagagagaagaaagggaggaaaggcgtgatagacggcaagagaagaatttgactaagatcttggccgcagtggttgaagggaagagcagcagggagagagagagagagagtttaggaaaattaggtcaggccctagacagtcagggaacctgggcaataggaccccactcgacaaggaccagtgtgcgtattgtaaagaaaaaggacactgggcaaggaactgccccaagaagggaaacaaaggaccgaaggtcctagctctggaagaagataaagattaggggagacggggttcggaccccctccccgagcccagggtaactttgaaggtggaggggcaaccagttgagttcctggttgatactggagcagagcattcagtgctgctacaaccattaggaaaactaaaagaaaaaaaatcctgggtgatgggtgccacagggcaacggcagtatccatggactacccgaagaaccgttgacttgggagtgggacgggtaacccactcgtttctggtcatccctgagtgcccagtaccccttctaggtagagacttactgaccaagatgggagctcaaatttcttttgaacaaggaagaccagaagtgtctgtgaataacaaacccatcactgtgttgaccctccaattagatgatgaatatcgactatattctccccaagtaaagcctgatcaagatatacagtcctggttggagcagtttccccaagcctgggcagaaaccgcagggatgggtttggcaaagcaagttcccccacaggttattcagctgaaggccagtgctacaccagtatcagtcagacagtaccccttgagtagagaggctcgagaaggaatttggccgcatgttcaaagattaatccaatagggcatcctagttcctatccaatccccttggaatactcccctgctaccggttaggaagcctgggaccaatgattatcgaccagtacaggacttgagagaggtcaataaaagggtgcaggacatacacccaacggtcccgaacccttataacctcttgagcgccctcctgcctgaacggaactggtacacagtattggacttaaaagatgccttcttctgcctgagattacaccccactagccaaccactttttgccttcgaatggagagatccaggtacgggaagaactgggcagctcacctggacccgactgccccaagggttcaagaactccccgaccatctttgacgaagccctacacagagacctggccaacttcaggatccaacaccctcaggtgaccctcctccagtacgtggatgacctgcttctggcgggagccaccaaacaggactgcttagaaggtacgaaggcactactgctggaattgtctgacctaggctacagagcctccgctaagaaggcccagatttgcaggagagaggtaacatacttggggtacagtttgcgggacgggcagcgatggctgacggaggcacggaagaaaactgtagtccagataccggccccaaccacagccaaacaagtgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcgcctgctctggccctccctgatgtaactaaaccttttaccctttatgtggatgagcgtaagggagtagcccggggagttttaacctaaaccctaggaccatggagaagacctgttgcctacctgtcaaagaagctcgatcctatagccagtggttggcccgtatgcctgaaggctatcgcagctgtggccatactggtcaaggacgctgacaaattgactttgggacagaatataactataatagccccccatgcgttggaaaacatcgtccggcagcccccagaccgatggatgaccaacgctcgcatgacccactatcaaagcctgcttctcacagagaggatcacgtttgctccaccagccgctctcaaccctgccactcttctgcctgaagagactgatgaaccagtgactcatgattgccatcaactgttgatcgaggagactggggtccgcaaggaccttatagacataccactgactggagaagtgctgacctggttcactgatgggagcagctatgtagtggaaggtaagaggatggctggggcggcagtggtggacgggacccgcacgatctgggccagcagcctgccagaaggaacttcagcgcaaaaggctgagctcatggccctcacacaagctttgcggctggccgaagggaaatccataaacatttatacggacagcaggtatgcctttgcgactgcacacgtacacggggccatctataagcaaagggggttgcttacctcagcagggagggaaataaagaacaaagaggaaattctaagcctattagaagccttacatttgccaaaaaggctagctattatacactgtcctggacatcagaaagccaaagatctcatatccagagggaaccagatggctgaccgggttgccaagcaggcagcccagggtgttaaccttctgcctataatagaaacgcccaaagccccagaacccagacgacagtacaccctagaagactggcaagagataaaaaagatagaccagttctctgagactccggaggggacctgctatacctcggatgggaaggaaatcctgccccacaaagaagggttagaatatgtccaacagatacatcgtctaacccacctaggaactgaacacctgcagcagttggtcagaacgtccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccagctaaatacggaaacaaatatctattggtttttgtagacaccttttcaggatgggtagaggcttatcctactaagaaagagacttcaaccgtggtggctaagaaaatattggaggaaatttttccaagatttggaatacctaaagtaatagggtcagacaatggtccagcttttgttgcccaggtaagtcagggactggccaagacattggggattgattggaaattacattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccctatgaattgctctatgggggaccccccccgttggcagaaattgcctctgtacatagtgctgatgtgctgctttcccagcctttgttctctaggctcaaggcgctcgagtgggtgaggcagcgagcgtggaagcagctccgggaggcctactcaggaggagacttgcaagttccacatcgcttccaagttggagattcagtctatgttagacgccactgtacaggaaacctcgagactcggtggaagggcccttatctcgtacttttgaccacaccaacagctgtaaaagttgaaggaatctccacctggatccatgcatcccacgttaagccggcgccacctcccgattcggggtggagagccgaaaagactgaaaatccccttaagcttcgcctccatcgcttggttccttactctgtcaataactcctcaagttaatggtaaacgccttgcggacagcccgaacttccataaacccttatctctcacctggttacttactgactccagtacaggtattactattaacagcactcaaggggaggctcccttagggacctggtggcctgagttatatgtctgccttcgatcggtaatccctggtctcaacgaccaggccacaccccctgatgtactctgtgcttacaggtttaatgtttgcccaggacccccaaataatgaagaatattgtggaaatcctcaggatttcttttgcaagcaagggagctgcgtaacttctaatgatgggaattggaaatggccagtctctcagcaagacagagtaagttactcttttgttaacagtcctaccagttataatcaatttaattatggccatgggagatggaaagattggcaacagcgggtacaaaaagatgtacgaaataagcaaataagctgtcattcgttagatctagattacttaaaaataagttttactgaaaaaggaaaacaagaaaatattcaaaagtgggtaaatggtatgtcttggggaataatgtactatggaggcactgggagaaggaaaggatctgttctgactattcgcctcagaatagaaactcagatggaacctccggttgctataggaccaaataagggtttggctgaacaaggacctccaatccaagaacagaggccatctcctaacccctctgtttacaatacaacctctggattagtcccccctgagcctaacttcactattaaaacaggggcgaaactttttagcctcatccagggagcttttcaagctcttaactccacgactccagaggctacctcttcttgttggctttgcttagctttgagcccaccttactatgagggaatggctagaggagggaaattcaatgtgacaaaggaacatagagaccaatgtacatggggatcccaaaataagcttacccttactgaggtttctggaaaaggcacctgcatagggagggttcccccatcccaccaacacctttgtaaccacactgaagcctttaatcgaacctctgagagtcagtacctggtacctggttatgacaggtggtgggcatgtaatactggattaaccccttgtgtttccaccctggttttcaaccaaactaaagacttttgtgttatggtccaaattgtcccccgggtgtactactatcccgaaaaagcggtccttgatgaatatgactatagatataatcggccaaaaagagaacccatatccctgacactagctgtaatgctcggattgggagtggctgcaggcgtgggaacaggaacggctgccctaatcacaggaccacaacagctggagaaaggacttagtgacctacatcgaattgtaacggaagatctccaagccctagaaaaatctgtcagtaacctagaggaatccctaacctccttatctgaagtggttctacagaacagaagagggttagatctgttatttctaaaagaaggtgggttatgtgtagccttaaaagaagaatgttgcttctatgtagatcactcaggagccatcagagactccatgagcaagcttagagaaaggttagagaggcatcgaagggaaagagaggctgaccaggggtggtttgaaggatggctcaacaggtctccttggatgaccaccctgctttctgctctgacgggacccctagtagtcctgctcctgttacttacaattgggccttgcttaattaataggtttgttgcctttgttagagaacgagtgagtgcagtccagatcatggtacttaggcaacagtaccaaggccttctgagccaaggagaaactgacctctagccttcccagttctaagattagaactattaaccagagaagaagtggggaatgaaaggatgaaaatgcaacctaaccctcccagaacccaggaagttaataaaaagctctaaatgcccccgaattccagaccctgctcgctgccagtaaataggtagaaggtcacacttcctattgttctagggcctgctatcctggcctaagtaagataacagggaatgagttgactaattgcttatctggattctgtaaaactgactagcaccatagaagaattgattacacatagaaagccctagtgacctatcttaaatctctgcccggaagcctacgcagatgcggacctctggagctattttaaattgattggtccacggagcgcgggctttcgctattttaaattgattggtccacggatctcaatattttaaaatgattggtttgcaacgcacaggctttgttgtaaaccccataaaagctgtcccgaatccgcactcggggccgcagtcctctacccctgcgtggtgtatgactgtgggccccagcgcgcttggaataaaaatcctcttgctgtttgcatcaagaccgcttctcgtgagtgatttggggtgtcgcctcttccgagcccggacgagggggattgtacatttactggcctttcaggctgaggtactaaacctggaaaatggcagccaaacataacttgttccattcaatgttagttcattctagt

SEQ ID NO: 245 - DNA, 9162 bp, artificial
  338173776_A sequence
agtgaggccagggatctaacctgggtcttcgaggatgctagtcatatttgtttcagctgagtcataatgggaactccgtggcatgtgttctgattaaattggtagttggactgaaaggatgaaaatgcaacctgactctcccagaacccaggaagttaataagaagctctaaatgccctcgaattccagaccctgttccctataggtaaaagatcatactttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcataagataaaaagaggagaagtcaattgcctaacggaccccagtaagatcgggcgtgccacaaaatgttgaaaatcctgataaatatatcttggtgacaatatgtctcccccacccagagacaggcacaaacatgtaactccagaacaacttaaaattaattggtccacaaagcgcgggctctcgaagttttgaattgactggtttgcgatattttaaaaatgattagtttgtaaaagcgcgggctttgttgtgaaccccataaaagctgtcccgactccacactcggggccgcagtcctctacccctgcgtggcgtacgactgtgggccccagcgcgctcggaataaaaatcctcttgctgtttgcatcaagaccgcttctcgtgagtgatttggggtgtcgcctcttccgagtcaggacgagagggattttaactcgactggcctttcagtttggtgcgttggccgggaaacccgcgactacccctcacacccgagaaccgacttggaggtaaagggatcccctttggaacgtgtgagtgtgtgtgtcggctggcgtctctgttctgagtgtctgttttcggtgatgcgcgctttcggtttgcagctgtcctctcagaccgtaaggactgggggactgtgatcagcagacgtgctaggaggatcacaggctgccaccctgggggacgccccgggaggtggggagagccagggacgcctggtggtctccttctgtcggtcagaggaccgagttctgttgttgaagcgaaagcttccccctccgcggccgtccgactcttttgcctgcttgtggaagacgcggacgggtcgcgtgtgtctggatctgttggtttctgttttgtgtgtctttgtcttgtgcgtccttgtctacagttttaatatgggacagacggtgacgacccctcttagtttgactctcgaccattggactgaagttaaatccagggctcataatttgtcagttcaggttaagaagggaccttggcagactttctgtgtctctgaatggccgacattcgatgttggatggccatcagaggggacctttaattctgagattatcctggctgttaaagcaattatttttcagactggacccggctctcatcccgatcaggagccctatatccttacgtggcaagatttggcagaggatcctccgccatgggttaaaccttggctgaataagccaagaaagccaggtccccgaattctggctcttggagagaaaaacaaacactcggctgaaaaagtcaagccctctcctcatatctaccccgagattgaggagccgccggcttggccggaaccccaatctgttcccccacccccttatccggcacagggtgctgcgaggggaccctctgcccctcctggagctccggcggtggagggacctgctgcagggactcggagccggaggggcgccaccccggagcggacagacgagatcgcgacattaccgctgcgcacgtacggccctcccataccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaacttggctaaggtaagagaggtgatgcagggaccgaatgaacctccctcagtttttcttgagaggctcatggaagccttcaggcggttcaccccttttgatcctacctcggaggctcagaaagcctcagtggctctggccttcataggacagtcagccctggatatcagaaagaagcttcagagactggaagggttacaggaggctgagttacgtgatctagtgaaggaggcagagaaagtgtattacaaaagggagacagaagaagaaagggaacaaagaaaagagagagaaagagaggaaagggaggaaagacgtaataaacggcaagagaagaatttgactaagatcttggctgcagtggttgaagggaaaagcaatagggaaagagagagagattttaggaaaattaggtcaggccctagacagtcagggaacctgggcaataggaccccactcgacaaggaccaatgtgcatattgtaaagaaaaaggacactgggcaagggactgccccaagaagggaaacaaaggactgaaggtcttagctctggaagaagataaagactagggaagacggggttcggaccccctccccgagcccagggtaactttaaaggtggaggggcaaccagttgagtttctggttgataccggagcgaaacattcagtgctactacagccattaggaaaactaaaagataaaaaatcctgggtgatgggtgccacagggcaacaacaatatccatggactacccgaagaacagttgacttgggagtgggacgggtaacccactcgtttctggtcatacctgagtgcccagcacccctcttaggtagagacttactgaccaagatgggagcacaaatttcttttgaacaagggaaaccagaagtgtctgcaaataacaaacctatcactgtgttgaccctccaattagatgacgaatatcgactatattctcccctagtaaagcctgatcaaaatatacaattctggttggaacagtttccccaagcctgggcagaaaccgcagggatgggtttggcaaagcaagttcccccacaggttattcaactgaaagccagtgctgcaccagtgtcagtcagacagtaccccttgagtaaagaagctcgagaaggaattcggccgcatgttcaaagattaatccaacagggcatcctagttcctgtccaatctccctggaatactcccctgctaccggttagaaagcctgggactaatgactatcgaccagtacaggacttgagagaggtcaataaacgggtgcaggatatacacccaacagtcccgaacccttataacctcttgtgtgctctcccaccccaacggagctggtatacagtattggacttaaaggatgccttcttctgcctgagactacatcccactagccaaccactttttgccttcgaatggagagatccaggtgcgggaagaaccgggcagctcacttggactcgactgccccaagggttcaaaaactccccgaccatctttgacgaagccctacacagagacctggccaacttcaggatccaacacccccaggtgaccctcctccagtacgtggatgacctgcttctggcgggagccaccaaacaggactgcttagaaggtacgaaggcactactgctggaattgtctgacctaggctacagagcctccgctaagaaggcccagatttgcaggagagaggtaacatacttggggtacagtttgcggggcgggcagcgatggctgacggaggcacggaagagaactgtagtccagataccggccccaaccacagccaaacaagtgagagagtttttggggacagctggattttgcagactgtggatcccggggtttgcgaccttagcagccccactctacccactaaccaaagaaaaaggggaattctcctgggctcctgagcaccagaaggcatttgatgctatcaaaaaggccctgctgagcgcacctgctctggccctccctgacgtgactaaaccctttaccctttatgtggatgagcgtaagggagtagcccggggagttttaacccaaactctaggaccatggaggagacctgttgcctacctgtcaaagaagctcgatcctgtagccagtggttggcccgtatgcctgaaggctatcgcagctgtggccatactggtcaaggacgctgacaaattgactttgggacagaatataactgtaatagccccccatgcgttggagaacatcgttcggcagcccccagaccgatggatgaccaacgcccgcatgacccactatcaaagcctgcttctcacagagagggtcacgttcgctccaccagccgctctcaaccctgccactcttctgcctgaagagactgatgaaccagtgactcatgattgccatcaactattgattgaggagactggggtccgcaaggaccttacagacataccgctgactggagaagtgttaacctggttcactgacggaagcagctatgtggtggaaggtaagaggatggctggggcggcggtggtggacgggacccgcacgatctgggccagcagcctgccggaaggaacttcagcacaaaaggctgagctcatggccctcacgcaagctttgcggctggccgaagggaaatccataaacatttatacagacagcaggtatgcctttgcgactgcacacgtacacggggccatctataagcaaagggggttgcttacctcagcagggagggaaataaagaacaaagaggaaattctaagcctattagaagccttacatttgccaaaaaggctagctattatacactgtcctggacatcagtaagccaaagatcccatatccagagggaaccagatggctgaccgggttgccaagcaggcagcccagggtgttaaccttctgcctatgatagaaacacccaaagccccagaacccggacgacagtacaccctagaagactggcaagaaataaaaaagatagaccagttctctgaaactccggaggggacctgctatacctcagatgggaaggaaatcctgccccacaaagaagggttagaatatgtccaacagatacatcgtctaacccacctaggaactaaacacctgcagcagttggtcagaacatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaagaaaatactggaggaaatttttccaagatttggaatacctaaggtaatagggtcagacaatggtccagctttcgttgcccaggtaagtcagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggtgaggaacacccctggacagtttgggctgaccccctatgaattgctctacgggggaccccccccgttggcagaaattgcctttgcacatagtgctgatgtgctgctttcccagcctttgttctctaggctcaaggcgctcgagtgggtgaggcagcgagcgtggaagcagctccgggaggcctactcaggaggagacttgcaagttccacatcgcttccaagttggagattcagtctatgttagacgccaccgtgcaggaaacctcgagactcggtggaagggaccttatctcgtacttttgaccacaccaacggctgtgaaagtcgaaggaatccccacctggatccatgcatcccacgttaagccggcgccacctcccgattcggggtggaaagccgaaaagactgaaaaatccccttaagcttcgcctccatcgcgtggttccttactctgtcaataactcctcaagttaatggtaaacgccttgtggacagcccgaactcccataaacccttatctctcacctggttacttactgactccggtacaggtattaatattaacagcactcaaggggaggctcccttggggacctggtggcctgaattatatgtctgccttcgatcagtaatccctggtctcaatgaccaggccacaccccccgatgtactccgtgcttacgggttttacgtttgcccaggacccccaaataatgaagaatattgtggaaatcctcaggatttcttttgcaagcaatggagctgcgtaacttctaatgatgggaattggaaatggccagtctctcagcaagacagagtaagttactcttttgttaacaatcctaccagttataatcaatttaattatggccatgggagatggaaagattggcaacagcgggtacaaaaagatgtacgaaataagcaaataagctgtcattcgttagacctagattacttaaaaataagtttcactgaaaaaggaaaacaagaaaatattcaaaagtgggtaaatggtatgtcttggggaatagtgtactatggaggctctgggagaaagaaaggatctgttctgactattcgcctcagaatagaaactcagatggaacctccggttgctataggaccaaataagggtttggccgaacaaggacctccaatccaagaacagaggccatctcctaacccctctgattacaatacaacctctggatcagtccccactgagcctaacatcactattaaaacaggggcgaaactttttagcctcatccagggagcttttcaagctcttaactccacgactccagaggctacctcttcttgttggctttgcttagcttcgggcccaccttactatgagggaatggctagaggagggaaattcaatgtgacaaaggaacatagagaccaatgtacatggggatcccaaaataagcttacccttactgaggtttctggaaaaggcacctgcatagggatggttcccccatcccaccaacacctttgtaaccacactgaagcctttaatcgaacctctgagagtcaatatctggtacctggttatgacagggtggtgggcatgtaatactggattaaccccttgtgtttccaccttggttttcaaccaaactaaagacttttgcgttatggtccaaattgtcccccgggtgtactactatcccgaaaaagcagtccttgatgaatatgactatagatataatcggccaaaaagagagcccatatccctgacactagctgtaatgctcggattgggagtggctgcaggcgtgggaacaggaacggctgccctaatcacaggaccgcaacagctggagaaaggacttagtaacctacatcgaattgtaacggaagatctccaagccctagaaaaatctgtcagtaacctggaggaatccctaacctccttatctgaagtggttctacagaacagaagggggttagatctgttatttctaaaagaaggagggttatgtgtagccttaaaagaggaatgctgcttttatgtggatcattcaggagctatcagggactccatgagcaagctcagagaaaggttagaaaaacgtcacaaagaaaaagaggctggccaaggatggtttgagggatggttcaacaagtccccatgggtgaccaccctgctttctgctctaacaggacccctagtaatactgctcctgttgcttacagttgggccttgcttaattaatcggtttgttgcctttgttagagaacaagtgagtgcagttcggatcatggtacttagacagcagtaccaaggccttccaagctaaggagaaactgacctttagccttcctagttctaagattagaactattaacaagagaagaagtggggaatgaaaggatgaaaatgcaacctgactctcccagaacccaggaagttaataagaagctctaaatgccctcgaattccagaccctgttccctataggtaaaagatcatactttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcataagataaaaagaggagaagtcaattgcctaacggaccccagtaagatcgggcgtgccacaaaatgttgaaaatcctgataaatatatcttggtgacaatatgtctcccccacccagagacaggcacaaacatgtaactccagaacaacttaaaattaattggtccacaaagcgcgggctctcgaagttttgaattgactggtttgcgatattttaaaaatgattagtttgtaaaagcgcgggctttgttgtgaaccccataaaagctgtcccgactccacactcggggccgcagtcctctacccctgcgtggcgtacgactgtgggccccagcgcgctcggaataaaaatcctcttgctgtttgcatcaagaccgcttctcgtgagtgatttggggtgtcgcctcttccgagtcaggacgagagggattttaactcgactggcctttcaggacaacccattttagctagctgcacaaactacattttaaatggttaatgttttagaggataaaatccatatcttctatttttaaattatttaaatgtgatatcttcccagtcatttaacacacccaaata

SEQ ID NO: 246 - DNA, 9083 bp, artificial
  338173774_A sequence
tggctcaacacttagaaaatgctcccattaatattatttactgctcttatcaatactcacctcctaattttttaaagttctatgtaatttatgtacattttatttaaaaaaattttttattatagttgatttagaatgttctttcatggagttcctgtcatggtgaaaggatgaaaatgcaacctgactctcccagaacccaggaagttaataagaagctctaaatgccctcgaattccagaccctgttccctataggtaaaagatcatactttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcataagataaaaagaggagaagtcaattgcctaacggaccccagtaagatcgggcgtgccacaaaatgttgaaaatcctgataaatatatcttggtgacaatatgtctcccccacccagagacaggcacaaacatgtaactccagaacaacttaaaattaattggtccacaaagcgcgggctctcgaagttttgaattgactggtttgcgatattttaaaaatgattagtttgtaaaagcgcgggctttgttgtgaaccccataaaagctgtcccgactccacactcggggccgcagtcctctacccctgcgtggcgtacgactgtgggccccagcgcgctcggaataaaaatcctcttgctgtttgcatcaagaccgcttctcgtgagtgatttggggtgtcgcctcttccgagtcaggacgagagggattttaactcgactggcctttcagtttggtgcgttggccgggaaacccgcgactacccctcacacccgagaaccgacttggaggtaaagggatcccctttggaacgtgtgagtgtgtgtgtcggctggcgtctctgttctgagtgtctgttttcggtgatgcgcgctttcggtttgcagctgtcctctcagaccgtaaggactgggggactgtgatcagcagacgtgctaggaggatcacaggctgccaccctgggggacgccccgggaggtggggagagccagggacgcctggtggtctccttctgtcggtcagaggaccgagttctgttgttgaagcgaaagcttccccctccgcggccgtccgactcttttgcctgcttgtggaagacgcggacgggtcgcgtgtgtctggatctgttggtttctgttttgtgtgtctttgtcttgtgcgtccttgtctacagttttaatatgggacagacggtgacgacccctcttagtttgactctcgaccattggactgaagttaaatccagggctcataatttgtcagttcaggttaagaagggaccttggcagactttctgtgtctctgaatggccgacattcgatgttggatggccatcagaggggacctttaattctgagattatcctggctgttaaagcaattatttttcagactggacccggctctcatcccgatcaggagccctatatccttacgtggcaagatttggcagaggatcctccgccatgggttaaaccttggctgaataagccaagaaagccaggtccccgaattctggctcttggagagaaaaacaaacactcggctgaaaaagtcaagccctctcctcatatctaccccgagattgaggagccgccggcttggccggaaccccaatctgttcccccacccccttatccggcacagggtgctgcgaggggaccctctgcccctcctggagctccggcggtggagggacctgctgcagggactcggagccggaggggcgccaccccggagcggacagacgagatcgcgacattaccgctgcgcacgtacggccctcccataccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaacttggctaaggtaagagaggtgatgcagggaccgaatgaacctccctcagtttttcttgagaggctcatggaagccttcaggcggttcaccccttttgatcctacctcggaggctcagaaagcctcagtggctctggccttcataggacagtcagccctggatatcagaaagaagcttcagagactggaagggttacaggaggctgagttacgtgatctagtgaaggaggcagagaaagtgtattacaaaagggagacagaagaagaaagggaacaaagaaaagagagagaaagagaggaaagggaggaaagacgtaataaacggcaagagaagaatttgactaagatcttggctgcagtggttgaagggaaaagcaatagggaaagagagagagattttaggaaaattaggtcaggccctagacagtcagggaacctgggcaataggaaccccactcgacaaggaccaatgtgcatattgtaaagaaaaaggacactgggcaagggactgccccaagaagggaaacaaaggactgaaggtcttagctctggaagaagataaagactagggaagacggggttcggaccccctccccgagcccagggtaactttaaaggtggaggggcaaccagttgagtttctggttgataccggagcgaaacattcagtgctactacagccattaggaaaactaaaagataaaaaatcctgggtgatgggtgccacagggcaacaacaatatccatggactacccgaagaacagttgacttgggagtgggacgggtaacccactcgtttctggtcatacctgagtgcccagcacccctcttaggtagagacttactgaccaagatgggagcacaaatttcttttgaacaagggaaaccagaagtgtctgcaaataacaaacctatcactgtgttgaccctccaattagatgacgaatatcgactatattctcccctagtaaagcctgatcaaaatatacaattctggttggaacagtttccccaagcctgggcagaaaccgcagggatgggtttggcaaagcaagttcccccacaggttattcaactgaaggccagtgctgcaccagtgtcagtcagacagtaccccttgagtaaagaagctcgagaaggaattcggccgcatgttcaaagattaatccaacagggcatcctagttcctgtccaatctccctggaatactcccctgctaccggttagaaagcctgggactaatgactatcgaccagtacaggacttgagagaggtcaataaacgggtgcaggatatacacccaacagtcccgaacccttataacctcttgtgtgctctcccaccccaacggagctggtatacagtattggacttaaaggatgccttcttctgcctgagactacatcccactagccaaccactttttgccttcgaatggagagatccaggtgcgggaagaaccgggcagctcacttggactcgactgccccaagggttcaaaaactccccgaccatctttgacgaagccctacacagagacctggccaacttcaggatccaacacccccaggtgaccctcctccagtacgtggatgacctgcttctggcgggagccaccaaacaggactgcttagaaggtacgaaggcactactgctggaattgtctgacctaggctacagagcctccgctaagaaggcccagatttgcaggagagaggtaacatacttggggtacagtttgcggggcgggcagcgatggctgacggaggcacggaagagaactgtagtccagataccggccccaaccacagccaaacaagtgagagagtttttggggacagctggattttgcagactgtggatcccggggtttgcgaccttagcagccccactctacccactaaccaaagaaaaaggggaattctcctgggctcctgagcaccagaaggcatttgatgctatcaaaaaggccctgctgagcgcacctgctctggccctccctgacgtgactaaaccctttaccctttatgtggatgagcgtaagggagtagcccggggagttttaacccaaactctaggaccatggaggagacctgttgcctacctgtcaaagaagctcgatcctgtagccagtggttggcccgtatgcctgaaggctatcgcagctgtggccatactggtcaaggacgctgacaaattgactttgggacagaatataactgtaatagccccccatgcgttggagaacatcgttcggcagcccccagaccgatggatgaccaacgcccgcatgacccactatcaaagcctgcttctcacagagagggtcacgttcgctccaccagccgctctcaaccctgccactcttctgcctgaagagactgatgaaccagtgactcatgattgccatcaactattgattgaggagactggggtccgcaaggaccttacagacataccgctgactggagaagtgttaacctggttcactgacggaagcagctatgtggtggaaggtaagaggatggctggggcggcggtggtggacgggacccgcacgatctgggccagcagcctgccggaaggaacttcagcacaaaaggctgagctcatggccctcacgcaagctttgcggctggccgaagggaaatccataaacatttatacagacagcaggtatgcctttgcgactgcacacgtacacggggccatctataagcaaagggggttgcttacctcagcagggagggaaataaagaacaaagaggaaattctaagcctattagaagccttacatttgccaaaaaggctagctattatacactgtcctggacatcagaaagccaaagatcccatatccagagggaaccagatggctgaccgggttgccaagcaggcagcccagggtgttaaccttctgcctatgatagaaacacccaaagccccagaacccggacgacagtacaccctagaagactggcaagaaataaaaaagatagaccagttctctgaaactccggaggggacctgctatacctcagatgggaaggaaatcctgccccacaaagaagggttagaatatgtccaacagatacatcgtctaacccacctaggaactaaacacctgcagcagttggtcagaacatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaagaaaatactggaggaaatttttccaagatttggaatacctaaggtaatagggtcagacaatggtccagctttcgttgcccaggtaagtcagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggtgaggaacacccctggacagtttgggctgaccccctatgaattgctctacgggggaccccccccgttggcagaaattgcctttgcacatagtgctgatgtgctgctttcccagcctttgttctctaggctcaaggcgctcgagtgggtgaggcagcgagcgtggaagcagctccgggaggcctactcaggaggagacttgcaagttccacatcgcttccaagttggagattcagtctatgttagacgccaccgtgcaggaaacctcgagactcggtggaagggaccttatctcgtacttttgaccacaccaacggctgtgaaagtcgaaggaatccccacctggatccatgcatcccacgttaagccggcgccacctcccgattcggggtggaaagccgaaaagactgaaaatccccttaagcttcgcctccatcgcgtggttccttactctgtcaataactcctcaagttaatggtaaacgccttgtggacagcccgaactcccataaacccttatctctcacctggttacttactgactccggtacaggtattaatattaacagcactcaaggggaggctcccttggggacctggtggcctgaattatatgtctgccttcgatcagtaatccctggtctcaatgaccaggccacaccccccgatgtactccgtgcttacgggttttacgtttgcccaggacccccaaataatgaagaatattgtggaaatcctcaggatttcttttgcaagcaatggagctgcgtaacttctaatgatgggaattggaaatggccagtctctcagcaagacagagtaagttactcttttgttaacaatcctaccagttataatcaatttaattatggccatgggagatggaaagattggcaacagcgggtacaaaaagatgtacgaaataagcaaataagctgtcattcgttagacctagattacttaaaaataagtttcactgaaaaaggaaaacaagaaaatattcaaaagtgggtaaatggtatgtcttggggaatagtgtactatggaggctctgggagaaagaaaggatctgttctgactattcgcctcagaatagaaactcagatggaacctccggttgctataggaccaaataagggtttggccgaacaaggacctccaatccaagaacagaggccatctcctaacccctctgattacaatacaacctctggatcagtccccactgagcctaacatcactattaaaacaggggcgaaactttttagcctcatccagggagcttttcaagctcttaactccacgactccagaggctacctcttcttgttggctttgcttagcttcgggcccaccttactatgagggaatggctagaggagggaaattcaatgtgacaaaggaacatagagaccaatgtacatggggatcccaaaataagcttacccttactgaggtttctggaaaaggcacctgcatagggatggttcccccatcccaccaacacctttgtaaccacactgaagcctttaatcgaacctctgagagtcagtatctggtacctggttatgacaggtggtgggcatgtaatactggattaaccccttgttttccaccttggttttcaaccaaactaaagacttttgcgttatggtccaaattgtcccccgggtgtactactatcccgaaaaagcagtccttgatgaatatgactatagatataatcggccaaaaagagagcccatatccctgacactagctgtaatgctcggattgggagtggctgcaggcgtgggaacaggaacggctgccctaatcacaggaccgcaacagctggagaaaggacttagtaacctacatcgaattgtaacggaagatctccaagccctagaaaaatctgtcagtaacctggaggaatccctaacctccttatctgaagtggttctacagaacagaagggggttagatctgttatttctaaaagaaggagggttatgtgtagccttaaaagaggaatgctgcttttatgtggatcattcaggagctatcagggactccatgagcaagctcagagaaaggttagaaaaacgtcacaaagaaaaagaggctggccaaggatggtttgagggatggttcaacaagtccccatgggtgaccaccctgctttctgctctaacaggacccctagtaatactgctcctgttgcttacagttgggccttgcttaattaatcggtttgttgcctttgttagagaacaagtgagtgcagttcggatcatggtacttagacagcagtaccaaggccttccaagctaaggagaaactgacctttagccttcctagttctaagattagaactattaacaagagaagaagtggggaatgaaaggatgaaaatgcaacctgactctcccagaacccaggaagttaataagaagctctaaatgccctcgaattccagaccctgttccctataggtaaaagatcatactttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcataagataaaaagaggagaagtcaattgcctaacggaccccagtaagatcgggcgtgccacaaaatgttgaaaatcctgataaatatatcttggtgacaatatgtctcccccacccagagacaggcacaaacatgtaactccagaacaacttaaaattaattggtccacaaagcgcgggctctcgaagttttgaattgactggtttgcgatattttaaaaatgattagtttgtaaaagcgcgggctttgttgtgaaccccataaaagctgtcccgactccacactcggggccgcagtcctctacccctgcgtggcgtacgactgtgggccccagcgcgctcggaataaaaatcctcttgctgtttgcatcaagaccgcttctcgtgagtgatttggggtgtcgcctcttccgagtcaggacgagagggattttaactcgactggcctttcagt

SEQ ID NO: 247 - DNA, 9084 bp, artificial
  1_A sequence
aatcaccagtgaatggctagtgattatgtaatgaagcctccataaaatccaaaggacagtgttcagagggcttcctggctggggaccacggggagatgtgggagcctagcatatctgcagagggcatggcaggtatgccttcccacataccttgtcctgtgcttctcttctacctggctattcttcagttatatccttttgtaataaaccaacagtctagtaagtaaattatttctgtgatttctgtgaggctctctagcaaattactcatacccaaggaagttctacataggtcttccgatctataactggtggatcagaagcacaagttaccacctagagttgtgattggcatcagaagtgggaggggatgggcagtctggtaggactgagcccttttaacccccgtgggatctgatgctatcttcaggtagatagcatcagaattgagttaaatttgtaggacatccatctggtagtgtctgagaattgcttggacctgaaaggatgaaaatgcaacctgactctcccagaacccaggaagttaataagaagctctaaatgccctcgaattccagaccctgttccctataggtaaaagatcatattttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcataagataaaaagaggagaagtcaattgcctaacggaccccagtaagatcgggcgtgccacaaaatgttgaaaatcctgataaatatatcttggtgacaatatgtctcccccacccagagacaggcacaaacatgtaactccagaacaacttaaaattaattggtccacaaagcgcgggctctcgaagttttgaattgactggtttgcgatattttaaaaatgattagtttgtaaaagcgcgggctttgttgtgaaccccataaaagctgtcccgactccacactcggggccgcagtcctctacccctgcgtggcgtacgactgtgggccccagcgcgctcggaataaaaatcctcttgctgtttgcatcaagaccgcttctcgtgagtgatttggggtgtcgcctcttccgagtcaggacgagagggattttaactcgactggcctttcagtttggtgcgttggccgggaaacccgcgactacccctcacacccgagaaccgacttggaggtaaagggatcccctttggaacgtgtgagtgtgtgtgtcggctggcgtctctgttctgagtgtctgttttcggtgatgcgcgctttcggtttgcagctgtcctctcagaccataaggactgggggactgtgatcagcagacgtgctaggaggatcacaggctgccaccctgggggacgccccgggaggtggggagagccagggacgcctggtggtctccttctgtcggtcagaggaccgagttctgttgttgaagcgaaagcttccccctccgcggccgtccgactcttttgcctgcttgtggaagacgcggacgggtcgcgtgtgtctggatctgttggtttctgttttgtgtgtctttgtcttgtgcgtccttgtctacagttttaatatgggacagacggtgacgacccctcttagtttgactctcgaccattggactgaagttaaatccagggctcataatttgtcagttcaggttaagaagggaccttggcagactttctgtgtctctgaatggccgacattcgatgttggatggccatcagaggggacctttaattctgagattatcctggctgttaaagcaattatttttcagactggacccggctctcatcccgatcaggagccctatatccttacgtggcaagatttggcagaggatcctccgccatgggttaaaccttggctgaataagccaagaaagccaggtccccgaattctggctcttggagagaaaaacaaacactcggctaaaaaagtcaagccctctcctcatatctaccccgagattgaggagccgccggcttggccggaaccccaatctgttcccccacccccttatccggcacagggtgctgcgaggggaccctctgcccctcctggagctccggcggtggagggacctgctgcagggactcggagccggaggggcgccaccccggagcggacagacgagatcgcgacattaccgctgcgcacgtacggccctcccataccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaacttggctaaggtaagagaggtgatgcagggaccgaatgaacctccctcagtttttcttgagaggctcatggaagccttcaggcggttcaccccttttgatcctacctcggaggctcagaaagcctcaatggctctggccttcataggacagtcagccctggatatcagaaagaagcttcagagactggaagggttacaggaggctgagttacgtgatctagtgaaggaggcaaaaaaagtgtattacaaaagggagacagaagaagaaagggaacaaagaaaagagagagaaagagaggaaagggaggaaagacgtaataaacggcaagagaagaatttgactaagatcttggctgcagtggttgaagggaaaagcaatagggaaagagagagagattttaggaaaattaggtcaggccctagacagtcagggaacctgggcaataggaccccactcgacaaggaccaatgtgcatattgtaaagaaaaaggacactgggcaagggactgccccaagaagggaaacaaaggactgaaggtcttagctctggaagaagataaagactagggaagacggggttcggaccccctccccgagcccagggtaactttaaaggtggaggggcaaccagttgagtttctggttgataccggagcgaaacattcagtgctactacagccattaggaaaactaaaagataaaaaatcctgggtgatgggtgccacagggcaacaacaatatccatggactacccgaagaacagttgacttgggagtgggacgggtaacccactcgtttctggtcatacctgagtgcccagcacccctcttaggtagagacttactgaccaagatgggagcacaaatttcttttgaacaagggaaaccagaagtgtctgcaaataacaaacctatcactgtgttgaccctccaattagatgacgaatatcgactatattctcccctagtaaagcctgatcaaaatatacaattctggttggaacagtttccccaagcctgggcagaaaccgcagggatgggtttggcaaagcaagttcccccacaggttattcaactgaaagccagtgctgcaccagtgtcagtcagacagtaccccttgagtaaagaagctcgagaagaaattcggccgcatgttcaaagattaatccaacagggcatcctagttcctgtccaatctccctggaatactcccctgctaccggttaaaaagcctgggactaatgactatcgaccagtacaggacttgagagaggtcaataaacgggtgcaggatatacacccaacagtcccgaacccttataacctcttgtgtgctctcccaccccaacggagctggtatacagtattggacttaaaggatgccttcttctgcctgagactacatcccactagccaaccactttttgccttcgaatggagagatccaggtgcgggaagaaccgggcagctcacttggactcgactgccccaagggttcaaaaactccccgaccatctttgacgaagccctacacagagacctggccaacttcaggatccaacacccccaggtgaccctcctccagtacgtggatgacctgcttctggcgggagccaccaaacaggactgcttagaaggtacgaaggcactactgctggaattgtctgacctaggctacagagcctccgctaagaaggcccagatttgcaggagagagataacatacttggggtacagtttgcggggcgggcagcgatggctgacggaggcacggaagagaactgtagtccagataccggccccaaccacagccaaacaagtgagagagtttttggggacagctggattttgcagactgtggatcccggggtttgcgaccttagcagccccactctacccactaaccaaagaaaaaggggaattctcctgggctcctgagcaccagaaggcatttgatgctatcaaaaaggccctgctgagcgcacctgctctggccctccctgacgtgactaaaccctttaccctttatgtggatgagcgtaagggagtagcccggggagttttaacccaaactctaagaccatggaggagacctgttgcctacctgtcaaagaagctcgatcctgtagccagtggttggcccatatgcctgaaggctatcgcagctgtggccatactggtcaaggacgctgacaaattgactttgggacagaatataactgtaatagccccccatgcgttggagaacatcgttcggcagcccccagaccgatggatgaccaacgcccgcatgacccactatcaaagcctgcttctcacagagagggtcacgttcgctccaccagccgctctcaaccctgccactcttctgcctgaagagactgatgaaccagtgactcatgattgccatcaactattgattgaggagactggggtccgcaaggaccttacagacataccgctgactggagaagtgttaacctggttcactgacggaagcagctatgtggtggaagacaccttttcaggatgggtagaggcttatcctactaagaaagagacttcaaccgtggtggctaagaaaatactggaggaaatttttccaagatttggaatacctaaggtaatagggtcagacaatggtccagctttcgttgcccaggtaagtcagggactggccaagatattggggattgattggaaactgcattgtgcatacagaccccaaagctcaggacaggtaaagaggatgaatagaaccattaaagagacccttaccaaattgaccacagagactggcattaatgattggatagctctcctgccctttgtgctttttagggtgaggaacacccctggacagtttgggctgaccccctataaattgctctacgggggacccccccccgttggcagaaattgcctttgcacatagtgctgatgtgctgctttcccagcctttgttctctaggctcaaggcgctcgagtgggtgaggcagcgagcgtggaagcagctccgggaggcctactcaggaggagacttgcaagttccacatcgcttccaagttggagattcagtctatgttagacgccaccgtgcaggaaacctcaagactcggtggaagggaccttatctcgtacttttgaccacaccaacggctgtgaaagtcgaaggaatccccacctggatccatgcatcccacgttaagccggcgccacctcccgattcggggtggaaagccgaaaagactgaaaatccccttaagcttcgcctccatcgcgtggttccttactctgtcaataactcctcaagttaatggtaaacgccttgtggacagcccgaactcccataaacccttatctctcacctggttacttactgactccggtacaggtattaatattaacagcactcaaggggaggctcccttggggacctggtggcctgaattatatgtctgccttcgatcagtaatccctggtctcaatgaccaggccacaccccccgatgtactccgtgcttacgggttttacgtttgcccaggacccccaaataatgaagaatattgtggaaatcctcaggatttcttttgcaagcaatggagctgcgtaacttctaatgatgggaattggaaatggccagtctctcagcaagacagagtaagttactcttttgttaacaatcctaccagttataatcaatttaattatggccatgggagatggaaagattggcaacagcgggtacaaaaagatgtacgaaataagcaaataagctgtcattcgttagacctagattacttaaaaataagtttcactgaaaaaggaaaacaagaaaatattcaaaagtgggtaaatggtatgtcttggggaatagtgtactatggaggctctgggagaaagaaaggatctgttctgactattcgcctcagaatagaaactcagatggaacctccggttgctataggaccaaataagggtttggccgaacaaggacctccaatccaagaacagaggccatctcctaacccctctgattacaatacaacctctggatcagtccccactgagcctaacatcactattaaaacaggggcgaaactttttaacctcatccagggagcttttcaagctcttaactccacgactccagaggctacctcttcttgttggctttgcttagcttcgggcccaccttactatgagggaatggctagaggagggaaattcaatgtgacaaaggaacatagagaccaatgtacatggggatcccaaaataagcttacccttactgaggtttctggaaaaggcacctgcatagggatggttcccccatcccaccaacacctttgtaaccacactaaagcctttaatcgaacctctgagagtcagtatctggtacctggttatgacaggtggtgggcatgtaatactggattaaccccttgtgtttccaccttggttttcaaccaaactaaagacttttgcgttatggtccaaattgtcccccgggtgtactactatcccgaaaaagcagtccttgatgaatatgactatagatataatcggccaaaaagagagcccatatccctgacactagctgtaatgctcggattgggagtggctgcaggcgtgggaacaggaacggctgccctaatcacaggaccgcaacagctggagaaaggacttagtaacctacatcgaattgtaacggaagatctccaagccctagaaaaatctgtcagtaacctagaggaatccctaacctccttatctgaagtggttctacagaacagaagggggttagatctgttatttctaaaagaaggagggttatgtgtagccttaaaagaggaatgctgcttttatgtggatcattcaggagctatcagggactccatgagcaagctcagagaaaggttagaaaaacgtcacaaagaaaaagaggctggccaaggatggtttgagggatggttcaacaagtccccatgggtgaccaccctgctttctgctctaacaggacccctagtaatactgctcctgttgcttacagttgggccttgcttaattaatcggtttgttgcctttgttagagaacaagtgagtgcagttcggatcatggtacttagacagcagtaccaaggccttccaagctaaggagaaactgacctttagccttcctagttctaagattagaactattaacaagagaagaagtggggaatgaaaggatgaaaatgcaacctgactctcccagaacccaggaagttaataagaagctctaaatgccctcgaattccagaccctgttccctataggtaaaagatcatactttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcataagataaaaagaggagaagtcaattgcctaacggaccccagtaagatcgggcgtgccacaaaatgttgaaaatcctgataaatatatcttggtgacaatatgtctcccccacccagagacaggcacaaacatgtaactccagaacaacttaaaattaattggtccacaaagcgcgggctctcgaagttttgaattgactggtttgcgatattttaaaaatgattagtttgtaaaagcgcgggctttgttgtgaaccccataaaagctgtcccgactccacactcggggccacagtcctctacccctgcgtggcgtacgactgtgggccccagcgcgctcggaataaaaatcctcttgctgtttgcatcaagaccgcttctcgtgagtgatttggggtgtcgcctcttccgagtcaggacgagagggatttaactcgactggcctttcagacccaacccagacattggagttggtcgcaatatcccaagatggttaaaagaaattctttctgcaaaagaggaactagagtaaagaggttaagtgagtggcctgactgaggatgagagctaagcaacccaacactttgccctttggctgtgtcttcctcgtacatcttgtctaaggatgaggccagttgtattctgtgaggagcgttgtgtggacctcatacacggacaacatgtcactgagtgcaaatgattttagtaaacagaaaggcaaggtcatacctcagctgcaccccagaagagctctgatctcaagggaaaatttgtaaaacagcttctctgggtaaaagggaaatgttgggggctctgagctgctagcaccctggaagagctgcatgatctgtgggcaaagagaaagattgtccttctaggacgttttagttgtccagtaagtgggttggtggagaagtttaagattggtattctgaatcaaaacttattt

SEQ ID NO: 248 - DNA, 8278 bp, artificial
  2_A sequence
  misc_feature (1435)..(1534): n is a, c, g, or t
taaagattccccaggtcctactgaaaggatgaaaatgcaacctgactctcccagaacccaggaagttaataagaagctctaaatgccctcgaattccagaccctgttccctataggtaaaagatcatactttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcataagataaaaagaggagaagtcaattgcctaacggaccccagtaagatcgggcgtgccacaaaatgttgaaaatcctgataaatatatcttggtgacaatatgtctcccccacccagagacaggcacaaacatgtaactccagaacaacttaaaattaattggtccacaaagcgcgggctctcgaagttttgaattgactggtttgcgatattttaaaaatgattagtttgtaaaagcgcgggctttgttgtgaaccccataaaagctgtcccgactccacactcggggccgcagtcctctacccctgcgtggcgtacgactgtgggccccagcgcgctcggaataaaaatcctcttgctgtttgcatcaagaccgcttctcgtgagtgatttggggtgtcgcctcttccgagtcaggacgagagggattttaactcgactggcctttcagtttggtgcgttggccgggaaacccgcgactacccctcacacccgagaaccgacttggaggtaaagggatcccctttggaacgtgtgagtgtgtgtgtcggctggcgtctctgttctgagtgtctgttttcggtgatgcgcgctttcggtttgcagctgtcctctcagaccgtaaggactgggggactgtgatcagcagacgtgctaggaggatcacaggctgccaccctgggggacgccccgggaggtggggagagccagggacgcctggtggtctccttctgtcggtcagaggaccgagttctgttgttgaagcgaaagcttccccctccgcggccgtccgactcttttgcctgcttgtggaagacgcggacgggtcgcgtgtgtctggatctgttggtttctgttttgtgtgtctttgtcttgtgcgtccttgtctacagttttaatatgggacagacggtgacgacccctttaaattggacgcccggccactggcttgcagtccctcagatggtctctagtggatcccccggcatctcaatctatcaatgttccacggtcgcttggtgcagggcgatgcagaacggatgatctgtcctgttttcccgaggagacgcctccttgtccttgttgcaagaaccagcctcatgggggtgagaaaggctgaagccattcgcacccccatgaggctggatctagcaacaaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagggaaacaaaggactgaaggtcttagctctgaaagaagataaagactagggaagacggggttcggaccccctccccgagcccagggtaactttaaaggtggaggggcaaccagttgagtttctggttgataccggagcgaaacattcagtgctactacagccattaggaaaactaaaagataaaaaatcctgggtgatgggtgccacagggcaacaacaatatccatggactacccgaagaacagttgacttgggagtgggacgggtaacccactcgtttctggtcatacctgagtgcccagcacccctcttaggtagagacttactgaccaagatgggagcacaaatttcttttgaacaagggaaaccagaagtgtctgcaaataacaaacctatcactgtgttgaccctccaattagatgacgaatatcgactatattctcccctagtaaagcctgatcaaaatatacaattctggttggaacagtttccccaagcctgggcagaaaccgcagggatgggtttggcaaagcaagttcccccacaggttattcaactgaaagccagtgctgcaccagtgtcagtcagacagtaccccttgagtaaagaagctcgagaaggaattcggccgcatgttcaaagattaatccaacagggcatcctagttcctgtccaatctccctggaatactcccctgctaccggttagaaagcctgggactaatgactatcgaccagtacaggacttgagagaggtcaataaacgggtgcaggatatacacccaacagtcccgaacccttataacctcttgtgtgctctcccaccccaacggagctggtatacagtattggacttaaaggatgccttcttctgcctgagactacatcccactagccaaccactttttgccttcgaatggagagatccaggtgcgggaagaaccgggcagctcacttggactcgactgccccaagggttcaaaaactccccgaccatctttgacgaagccctacacagagacctggccaacttcaggatccaacacccccaggtgaccctcctccagtacgtggatgacctgcttctggcgggagccaccaaacaggactgcttagaaggtacgaaggcactactgctggaattgtctgacctaggctacagagcctccgctaagaaggcccagatttgcaggagagaggtaacatacttggggtacagtttgcggggcgggcagcgatggctgacggaggcacggaagagaactgtagtccagataccggccccaaccacagccaaacaagtgagagagtttttggggacagctggattttgcagactgtggatcccggggtttgcgaccttagcagccccactctacccactaaccaaagaaaaaggggaattctcctgggctcctgagcaccagaaggcatttgatgctatcaaaaaggccctgctgagcgcacctgctctggccctccctgacgtgactaaaccctttaccctttatgtggatgagcgtaagggagtagcccggggagttttaacccaaactctaggaccatggaggagacctgttgcctacctgtcaaagaagctcgatcctgtagccagtggttggcccatatgcctgaaggctatcgcagctgtggccatactggtcaaggacgctgacaaattgactttgggacagaatataactgtaatagccccccatgcgttggagaacatcgttcggcagcccccagaccgatggatgaccaacgcccgcatgacccactatcaaagcctgcttctcacagagagggtcacgttcgctccaccagccgctctcaaccctgccactcttctgcctgaagagactgatgaaccagtgactcatgattgccatcaactattgattgaggagactggggtccgcaaggaccttacagacataccgctgactggagaaatgttaacctggttcactgacggaagcagctatgtggtggaaggtaagaggatggctggggcggcggtggtggacgggacccgcacgatctgggccagcagcctgccggaaggaacttcagcacaaaaggctgagctcatggccctcacgcaagctttgcggctggccgaagggaaatccataaacatttatacagacagcaggtatgcctttgcgactgcacacgtacacggggccatctataagcaaagggggttgcttacctcagcagggagggaaataaagaacaaagaggaaattctaagcctattagaagccttacatttgccaaaaaggctagctattatacactgtcctggacatcagaaagccaaagatcccatatccagagggaaccagatggctgaccgggttgccaagcaggcagcccagggtgttaaccttctgcctatgatagaaacacccaaagccccagaacccggacgacagtacaccctagaagactggcaagaaataaaaaagatagaccagttctctgaaactccggaggggacctgctatacctcagatgggaaggaaatcctgccccacaaagaagggttagaatatgtccaacagatacatcgtctaacccacctaggaactaaacacctgcagcagttggtcagaacatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaagaaaatactggaggaaatttttccaagatttggaatacctaaggtaatagggtcagacaatggtccagctttcgttgcccaggtaagtcagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggtgaggaacacccctggacagtttgggctgaccccctatgaattgctctacgggggaccccccccgttggcagaaattgcctttgcacatagtgctgatgtgctgctttcccagcctttgttctctaggctcaaggcgctcgagtgggtgaggcagcgagcgtggaagcagctccgggaggcctactcaggaggagacttgcaagttccacatcgcttccaagttggagattcagtctatgttagacgccaccgtgcaggaaacctcgagactcggtggaagggaccttatctcgtacttttgaccacaccaacggctgtgaaagtcgaaggaatccccacctggatccatgcatcccacgttaagccggcgccacctcccgattcggggtggaaagccgaaaagactgaaaatccccttaagcttcgcctccatcgcgtggttccttactctgtcaataactcctcaagttaatggtaaacgccttgtggacagcccgaactcccataaacccttatctctcacctggttacttactgactccggtacaggtattaatattaacagcactcaaggggaggctcccttggggacctggtggcctgaattatatgtctgccttcgatcagtaatccctggtctcaatgaccaggccacaccccccgatgtactccgtgcttacgggttttacgtttgcccaggacccccaaataatgaagaatattgtggaaatcctcaggatttcttttgcaagcaatggagctgcgtaacttctaatgatgggaattggaaatggccagtctctcagcaagacagagtaagttactcttttgttaacaatcctaccagttataatcaatttaattatggccatgggagatggaaagattggcaacagcgggtacaaaaagatgtacgaaataagcaaataagctgtcattcgttagacctagattacttaaaaataagtttcactgaaaaaggaaaacaagaaaatattcaaaagtgggtaaatggtatgtcttggggaatagtgtactatggaggctctgggagaaagaaaggatctgttctgactattcgcctcagaatagaaactcagatggaacctccggttgctataggaccaaataagggtttggccgaacaaggacctccaatccaagaacagaggccatctcctaacccctctgattacaatacaacctctggatcagtccccactgagcctaacatcactattaaaacaggggcgaaactttttaacctcatccagggagcttttcaagctcttaactccacgactccagaggctacctcttcttgttggctttgcttagcttcgggcccaccttactatgagggaatggctagaggagggaaattcaatgtgacaaaggaacatagagaccaatgtacatggggatcccaaaataagcttacccttactgaggtttctggaaaaggcacctgcatagggatggttcccccatcccaccaacacctttgtaaccacactgaagcctttaatcgaacctctgagagtcagtatctggtacctggttatgacaggtggtgggcatgtaatactggattaaccccttgtgtttccaccttggttttcaaccaaactaaagacttttgcgttatggtccaaattgtcccccgggtgtactactatcccgaaaaagcagtccttgatgaatatgactatagatataatcggccaaaaagagagcccatatccctgacactagctgtaatgctcggattgggaatggctgcaggcgtgggaacaggaacggctgccctaatcacaggaccgcaacagctggagaaaggacttagtaacctacatcgaattgtaacggaagatctccaagccctagaaaaatctgtcagtaacctggaggaatccctaacctccttatctgaagtggttctacagaacagaagggggttagatctgttatttctaaaagaaggagggttatgtgtagccgtaaaagaggaatgctgctttgatgtggatcattcaggagctatcagggactccatgagcaagctcagagaaaggttagaaaatcgtcacaaagaaaaagaggctggccaaggatggtttgagggatggttcaacaagtccccatgggtgaccaccctgctttctgctctaacaggacccctagtaatactgctcctgttgcttacagttgggccttgcttaattaatcggtttgttgcctttgttagagaacaagtgagtgcagttcggatcatggtacttagacagcagtaccaaggccttccaagctaaggagaaactgacctttagccttcctagttctaagattagaactattaacaagagaagaagtggggaatgaaaggatgaaaatgcaacctgactctcccagaacccaggaagttaataagaagctctaaatgccctcgaattccagaccctgttccctataggtaaaagatcatactttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcataagataaaaagaggagaagtcaattgcctaacggaccccagtaagatcgggcgtgccacaaaatgttgaaaatcctgataaatatatcttggtgacaatatgtctcccccacccagagacaggcacaaacatgtaactccagaacaacttaaaattaattggtccacaaagcgcgggctctcgaagttttgaattgactggtttgcgatattttaaaaatgattagtttgtaaaagcgcgggctttgttgtgaaccccataaaagctgtcccgactccacactcggggccgcagtcctctacccctgcgtggcgtacgactgtgggccccagcgcgctcggaataaaaatcctcttgctgtttgcatcaagaccgcttctcgtgagtgatttggggtgtcgcctcttccgagtcaggacgagagggattttaactcgactggcctttcactacccctactgggaaatcaaagtttaacaaatgccccaggtgcttctcatgctcagacaagtttggaatacgctgtgttaaaacctaaaacccaagacactgggagctgacttaacagcaatgtcctagatatttttaagaacgggttggtgctccttgaagtaatgcagccattcaagaagaaaagagatgggcaaaaaggaaattaaagccctctagagatcaatcagtcagccagtcaaataaaaatggtcccctggtccccttctcttgcagattttctgcggatttttaccgtctctcgttctggacttaagcaacgtcttctcggtacagattttgtgactgctgtcaacaccagacccattcccacactggaaggctcagtaacatgctgctagtctggcgtcatcactaattaaggagttgagtagagtaactgaagcagtaagttaataagagactgcaagtgttggctttcatctgggagaggttatgg

SEQ ID NO: 249 - DNA, 8076 bp, artificial
  3_A sequence
gacttccttatttgttgtgcctgaggcaaaggccctgtgctcctcacccagcccctcccactcagctcaccctgccggaagtgaggcaaaggtagagctgaatgaggatgagggttgggagcaaaagagcagtatgattgaaggtgacccaggaactgaaaggatgaaaatgcaacctgactctcccagaacccaggaagttaataagaagctctaaatgccctcgaattccagaccctgttccctataggtaaaagatcatactttttgctgttttagggcttgctttctgctctgtacaaaactttgtggaaggggaaaaacaggcccctgagtatgtgcctctatgcttgaaacttcttgaaactacttgagataacagggaaagggttcctaactgcttgtttggcttctgtaaacctgcttgcataagataaaaagaggagaagtcaatcgcctaaccgaccccagtaagatcgggcgtgccacaaaatgttgaaaattctgataaatatatcttggcgacaacatgtctcccctgcccaggaacaggcacaaacatgtaactccaaaacaatttaaattaattggtccacaaagcgcaggctctcgatgttttaaaatgattggtttgtgaagtgcgggctttgttgtgaaccccataaaagctgtcccgactccgcactaggggccacagtcctctacccctgcgtggcgtatgactgtgagccccagcgcgcttggaataatcctcttgctgtttgcatcaagaccgcttctcctgagtgatttggggtgtcgcctcttccgagtccagacgagggggattttccttctgctggcctttcatttggtgcgttggccgggaaaccccgcgaccacccctcacacccaagaaccgacttggaggtaaagggatcccctttggaatgtgtgtgtgcgtgccggccggcgtctctgttctgagtgtctgttttcggtgatgtgcgctttcagtttgcagctgtcctctcagaccgtaaggactgggggactgtgatcagcagacgtgctaggaggatcacaggctgccaccctgggggacgccccgggagctggggagagccaaggacgcctggtggtctccttctgtcggtcagaggaccgagttctgttgttgaagcaaaagcttccccctccgcggccgtctgactcttttgcctgcttgtggaaggcgcggacgggtcgcgtgtgtctggatctgttggtttctgtttcgtgtgtctttgtcttgtgcgtccttgtctacagttttaatatgggacagacggtgacgacccccccttagtttgactctcgaccatttggactgaagttaaatccagggctcataatttgtcagttcaggttaagaagggacctttaattctgagattatcctggctgttaaagcaaatatttttcagactggacccggctctcatcctgatcaggagccctatatccttacatggcaagatttggcagaagatcctccgccatgggttaaaccatggctaaataaaccaagatagccaggtccccaagttctggctcttggagagaaaaacaaacactcggctgaaaaagtcaagccctctcctcatatctaccccgagattgaggagccgccggcttggccggaaccccaatctgttcccccacccccttatccggcacagggtgctgcgaggggaccctctgcccctcctggagctccagcggtggagggacctgctgcagggactcggagccggaggggcgccaccccggagcggacagacgagattgcgacattaccgctgcgcacgtacggccctcccataccggggggccaattgcagcccctccagtattggcccttttcttctgcagatctttataattgaaaatctaaccatccccctttctcggaggatccccaatgcctcacggggttggtggagtcccttatgttctctcaccagcctacttgggatgattgtcaacaactgctacagacactctccacaaccggggagcgagagagaattctgttagaggcttaaaaaaaaaaaaaaaaaatgttcctggggccgacgggcgacccacacagttgcaaaatgagattgacatgggatttcccttgactcgccccattgggactacaacacggctgaaggtagggagagcttgaaaatctatcgccaggctctggtggtgggtctctggggcgcctcaagacggcccacaaatttggctaaggtaagagaggtgatgcagggaccgaacgaacctccctcggtatttcttgagaggatcatggaagcctttaggtggttcaccccttttgatcctacctcggaggcccagaaagcttcaatggccctggccttcataggacaggcagctctggatatcagaaagaaatgtcagagactggaagggttacaggaggctgagttacgtgatctagtgaaggaggcagagaaagtgtattacaaaagggagacagaagaagaaagggaacaaaaaaaagcgagagaaagagaggaaagggaggaaagacgtaataaacggcaagagaagaatttgactaagatcttggctgcagtggttgaagggaaaagcaatagagaaagagagagagattttaggaaaattaggtcaggccctagacagtcagggaacctgggcaataggaccccactcgacaaggaccaatgtgcatattgtaaagaaaaaggacactgggcaagggactgccccaagaagggaaacaaaggactgaaggtcttagctctggaagaagataaagactagggaagacggggttcggaccccctccccgagcccagggtaactttaaaggtggaggggcaaccagttgagtttctggttgataccggagcgaaacattcagtgctactacagccattaggaaaactaaaagataaaaaatcctgggtgatgggtgccacagggcaacgacagtatccatggactacccgaagaacagttgacttgggagttggacgggtaacccactcgtttctggtcatccctgagtgcccagcacccctcttaggtagagacttattgaccaagatgggagcacaaatttcttttgaacaagggaaaccagaagtgtctgcaaataacaaacctatcactgtgttgaccctccaattagatgacgaatatcgactatattctcccctagtaaagcctgatcaaaatatacagttctggttggaacagtttccccaagcctgggcagaaaccgcagggatgggtttggcaaagcaagttcccccacaggttattcaactgaaggccagtgctacaccagtgtcagtcagacagtaccccttgagtaaagaagctcgagaaggaattcggccgcatgttcaaagattaatccaacagggcatcctagttcctgtccaatctccctggaatactcccctgctaccggttagaaagcctgggaccaatgactatcgaccagtacaggacttgagagaggtcaataaatgggtgcaggatatacacccaacagtcccgaacccttataacctcttgtgtgctctcccaccccaacggagctggtacacagtattggacttaaaggatgccttcttctgcctgagactacatcccactagccaaccactttttgccttcgaatggagagatccaggtgcgggaagaaccgggcagctcacttggacccgactgccccaagggttcaaaaactccccgaccatctttgacgaagccctacacagagacctggccaacttcaggatccaacacccccaggtgaccctcctccagtacgtggatgacctgcttctagcgggagacaccaaacaggactgcttaaaaggtacaaaggcactactactagaattgtctgacctaggctaccgagcctcagctaaaaaggcccagatttgcaggagagaagtaacatacctggggtacagtctgcaggacgggcagcgatggctgacggaggcacggaagagaactgtagcccagataccgaccccaaccacagccaagcaagtgagagagtttttggggacagctgggttttgcgaccttagcagccccactctacccactaaccaaagaaaaaggggagttctcctgggctcctgagcaccagaaggcatttgatgctatcaaaaaggccctgctgagcgcacctgctctggccctccctgacgtaactaaaccctttaccctttatgtggatgagcgtaagggaatagcccggggagttttaacccaaaccctaggaccatggaggagacctgttgcctacctgtcaaagaagctcgatcctgtagccagtggttggcccgtatgcctgaaggctatcgcagctgtggccatactggtcaaggacgctgacaaattgactttgggacagaatataactgtaatagccccccatgcgttggagaacatcgttcggcagcccccagaccgatggatgaccaacgcccgcatgacccactatcaaagcctgcttctcacagagagggtcacgttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaggatggctggggcggcggtggtggatgggacccgcacgatctgggccagcagcctgccagaagggacttcagcacaaaaggctgagctcatggccctcacgcaagctttgcggctggccgaagggaaatccataaacatttatacggacagcaggtatgcctttgcgactgcacacatacatggggccatctataagcaaagggggttgcttacctcagcagggagggaaataaagaacaaagaggaaattctaagcctattagaagccttacatttgccaaaaaggctagctattatacactgtcctggacatcagaaagccaaagatcccatatccagagggaaccagatggctgaccgggttgccaagcaggcagcccagggtgttaaccttctgcctataatagaaacacccaaagccccagaacccggacgacagtacaccctagaagactggcaagagataaaaaagatagaccagttctctgaaactccggaggggacctgctatacctcagatgggaaggaaatcctgccccacaaagaagggttagaatatgtccaacagatacatcatctaacccacctaggaaataaacacctgcagcagttggtcagaacatccccttatcatgttctgaggctaccaggagtggctgactcggtggtcaaacattgtgtgccctgccagctggttaatgctaatccttccagaatacctccgggaaagagactaaggggaagccacccaggcgctcactgggaagtggacttcactgaggtaaagccagctaaatacggaaacaaatatctattggtttttatagacaccttttcaggatgggtagaggcttatcctactaagaaagagacttcaaccgtggtggctaagaaaatattggaggaaatttttccaagatttggaatacctaaggtaacagggtcagacaatggtccagcttttgttgcccaggtaagtcagggactggccaagatattggggattgattggaaactgcattgtgcatacagaccccaaagctcaggacaggtagagaggatgaatagaaccattaaagagacccttaccaaattgaccacagagactggcgttaatgattggataactctcctgccctttgtgcttttcaggattaggaacacccctggacagtttgggctgaccccctatgaattgctctatgccccccccccccggcagaaattgcctttgcacatagtgctgatgtgctgctttcccagcctttgttctctaggctcaaggcgctcgagtgggtgaggcagcgagcgtggaagcagccccgagaggcctactcaggaggagacttgcaagttccacatcgcttccaagttggagattcagtctatgttagacgccaccgtgcaggaaacctcgagactcggtggaagggcccttatctcgtacttttgaccacaccaacagctgtgaaagtcgaaggaatccccacctggatccatgcatcccacgttaagccggcgccacctcccgattcagggtggaaagccgaaaagactgagaacccccttaagctttgcctccatcgcttggttccttactctatcaataaccactcaagctaatagtaaacgccttgtggacagcccgacctcccataaacccttatccctcacctggctacttactgattccagtacaggtattactattaacagcactcaaagggaagctcccttagggacttggtggcctgagctacatgtctgccttcgattggtaatccctgatcttaacaccatgtccacaccccccgatatactccgtgcttacgggttttatgtttgcccaggacccccaaataatgaaaaatcttgtggtaaccccagggatttcttttgtaaacaatggagttgcgtaacctctaatgatggatattggaaatggccaacctctcggcaagatagggtaagtttctcttatgttaacacttataccagctctaaacaatttaattacctagattggattaaacagaaaactaccaattgctctccttcagacctggattacctgaaaataagtttcactgaaaagggaaaacaggaaaatattcaaaagtggataaacggtatgtcttggggagtagtgtactatagaggctcatggggaggagaaggatctattctaactattcgcctcagaatagaaactcagatggaacctccggttgctgtaggaccgaataaggtattagccgaacaaggacctccaatccaagaacagaggccatctcctaatccctctgatttcaatacaacctctggatcagtccccactgaacagttgggccttgcttaattaataggtttgttgcctttgttagagaatgagtgaatgcagtccagatcgtggtacttagacagtagtaccaaggccttccaagctaaggagaaactgacctttagccttcctagttctaagattagaactattaacaagagaagaagtggggaatgaaaggatgaaaatgcaacctgactctcccagaacccaggaagttaataagaagctctaaatgccctcgaattccagaccctgttccctataggtaaaagatcatactttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcataagataaaaagaggagaagtcaatcgcctaaccgaccccagtaagatcgggcgtgccacaaaatgttgaaaattctgataaatatatctttggcgacaacatgtctcccctgcccaggaacaggcacaaacatgtaactccaaaacaatttaaattaattggttcacaaagcgcgggctctcgatgttttaaaatgattggtttgtgaagtgcgggctttgttgtgaaccccataaaagctgtcccgactccgcactaggggccgcagtcctctacccctgcgtggcgtacgactgtgagccccagcgcgcttggaataaaaatcctcttgctgtttgcatcaagaccgcttctcctgagtgatttggggtgtcgcctcttccgagtccagacgagggggattttccttctgctggcctttcagaacctctttgaagatggttagggcagaacttgctgggaggaacagaagcagaggctggaccagcctcacccttgcaagcctccgccctttgcagggtgcctttcctttggcctgtaagcctagtccagctca

SEQ ID NO: 250 - DNA, 8865 bp, artificial
  4_A sequence
  misc_feature (2785)..(2884): n is a, c, g, or t
cgtgaccagagatgataagggagaccagagatgataagggagacacagcattaaaggagcaagacgaatgtgtcaaaaaggaggggattcatgctctgtagataatcagtttctgggaaaatatctacccctctggtcatgacgaaactgacacactaacagcctgaacctagccagaacacagactcggacttgaacctgcgtgtaggcactcgaacccagtctaaacacagactgggacttaaacccatggttttaaattagaatcactcatctggtgtctggactcactgaggttcaggttcttcatgcctctgcgcagaaggaactccgaaagagacaaagtgataggcaagaaacagatttattaagataggacactggtgacagatgcaagcaggcagggaaggaggctctgccttgaggattaggtgggctacagttttatcatccaaggggagtgggggtccgaaaataccgcccctttctgggagtagtagtgaaaggatgaaaatgcaacctgactctcccagaacccaggaagttaataagaagctctaaatgccctcgaattccagaccctgttccctataggtaaaagatcatactttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcataagataaaaagaggagaagtcaattgcctaacggaccccagtaagatcgggcgtgccacaaaatgttgaaaatcctgataaatatatcttggtgacaatatgtctcccccacccagagacaggcacaaacatgtaactccagaacaacttaaaattaattggtccacaaagcgcgggctctcgaagttttgaattgactggtttgcgatattttaaaaatgattagtttgtaaaagcgcgggctttgttgtgaaccccataaaagctgtcccgactccacactcggggccgcagtcctctacccctgcgtggcgtacgactgtgggccccagcgcgctcggaataaaaatcctcttgctgtttgcatcaagaccgcttctcgtgagtgatttggggtgtcgcctcttccgagtcaggacgagagggattttaactcgactggcctttcagtttggtgcattggccgggaaacccgcgactacccctcacacccgagaaccgacttggaggtaaagggatcccctttggaacgtgtgagtgtgtgtgtcggctggcgtctctgttctgagtgtctgttttcggtgatgcgcgctttcggtttgcagctgtcctctcagaccgtaaggactgggggactgtgatcagcagacgtgctaggaggatcacaggctgccaccctgggggacgccccgggaggtggggagagccagggacgcctggtggtctccttctgtcggtcagaggaccgagttctgttgttgaagcgaaagcttccccctccgcggccgtccgactcttttgcctgcttgtggaagacgcggacgggtcgcgtgtgtctggatctgttggtttctgttttgtgtgtctttgtcttgtgcgtccttgtctacagttttaatatgggacagacggtgacgacccctcttagtttgactctcgaccattggactgaagttaaatccagggctcataatttgtcagttcaggttaagaagggaccttggcagactttctgtgtctctgaatggccgacattcgatgttggatggccatcagaggggacctttaattctgagattatcctggctgttaaagcaattatttttcagactggacccggctctcatcccgatcaggagccctatatccttacgtggcaagatttggcagaggatcctccgccatgggttaaaccttggctgaataagccaagaaagccaggtccccgaattctggctcttggagagaaaaacaaacactcggctgaaaaagtcaagccctctcctcatatctaccccgagattgaggagccgccggcttggccggaaccccaatctgttcccccacccccttatccggcacagggtgctgcgaggggaccctctgcccctcctggagctccggcggtggagggacctgctgcagggactcggagccggaggggcgccaccccggagcggacagacgagatcgcgacattaccgctgcgcacgtacggccctcccataccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaacttggctaagggtagagaggtgatgcagggaccggatgaaccttcctcagttttcttgagagctcatggagccttcaggcgtcacccctttgatcctactcggagctcaaaagctcagtgctctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccatctaggaaactaaaagataaaaaatcctgggtgatgggtgccacagggcaacaacaatatccatggactacccgaagaacagttgacttgggagtgggacgggtaacccactcgtttctggtcatacctgagtgcccagcacccctcttaggtagagacttactgaccaagatgggagcacaaatttcttttgaacaagggaaaccagaagtgtctgcaaataacaaacctatcactgtgttgaccctccaattagatgacgaatatcgactatattctcccctagtaaagcctgatcaaaatatacaattctggttggaacagtttccccaagcctgggcagaaaccgcagggatgggtttggcaaagcaagttcccccacaggttattcaactgaaagccagtgctgcaccagtgtcagtcagacagtaccccttgagtaaagaagctcgagaaggaattcggccgcatgttcaaagattaatccaacagggcatcctagttcctgtccaatctccctggaatactcccctgctaccggttagaaagcctgggactaatgactatcgaccagtacaggacttgagagaggtcaataaacgggtgcaggatatacacccaacagtcccgaacccttataacctcttgtgtgctctcccaccccaacggagctggtatacagtattggacttaaaggatgccttcttctgcctgagactacatcccactagccaaccactttttgccttcgaatggagagatccaggtgcgggaagaaccgggcagctcacttggactcgactgccccaagggttcaaaaactccccgaccatctttgacgaagccctacacagagacctggccaacttcaggatccaacacccccaggtgaccctcctccagtacgtggatgacctgcttctggcgggagccaccaaacaggactgcttagaaggtacgaaggcactactgctggaattgtctgacctaggctacagagcctccgctaagaaggcccagatttgcaggagagaggtaacatacttggggtacagtttgcggggcgggcagcgatggctgacggaggcacggaagagaactgtagtccagataccggccccaaccacagccaaacaagtgagagagtttttggggacagctggattttgcagactgtggatcccggggtttgcgaccttagcagccccactctacccactaaccaaagaaaaaggggaattctcctgggctcctgagcaccagaaggcatttgatgctatcaaaaaggccctgctgagcgcacctgctctggccctccctgacgtgactaaaccctttaccctttatgtggatgagcgtaagggagtagcccggggagttttaacccaaactctaggaccatggaggagacctgttgcctacctgtcaaagaagctcgatcctgtagccagtggttggcccgtatgcctgaaggctatcgcagctgtggccatactggtcaaggacgctgacaaattgactttgggacagaatataactgtaatagccccccatgcgttggagaacatcgttcggcagcccccagaccgatggatgaccaacgcccgcatgacccactatcaaagcctgcttctcacagagagggtcacgttcgctccaccagccgctctcaaccctgccactcttctgcctgaagagactgatgaaccagtgactcatgattgccatcaactattgattgaggagactggggtccgcaaggaccttacagacataccgctgactggagaagtgttaacctggttcactgacggaagcagctatgtggtggaaggtaagaggatggctggggcggcggtggtggacgggacccgcacgatctgggccagcagcctgccggaaggaacttcagcacaaaaggctgagctcatggccctcacgcaagctttgcggctggccgaagggaaatccataaacatttatacagacagcaggtatgcctttgcgactgcacacgtacacggggccatctataagcaaagggggttgcttacctcagcagggagggaaataaagaacaaagaggaaattctaagcctattagaagccttacatttgccaaaaaggctagctattatacactgtcctggacatcagaaagccaaagatcccatatccagagggaaccagatggctgaccgggttgccaagcaggcagcccagggtgttaaccttctgcctatgatagaaacacccaaagccccagaacccggatgacagtacaccctagaagactggcaagaaataaaaaagatagaccagttctctgaaactccggaggggacctgctatacctcagatgggaaggaaatcctgccctttgtgctttttagggtgaggaacacccctggacagtttgggctgaccccctatgaattgctctacgggggaccccccccgttggcagaaattgcctttgcacatagtgctgatgtgctgctttcccagcctttgttctctaggctcaaggcgctcgagtgggtgaggcagcgagcgtggaagcagctccgggaggcctactcaggaggagacttgcaagttccacatcgcttccaagttggagattcagtctatgttagacgccaccgtgcaggaaacctcgagactcggtggaagggaccttatctcgtacttttgaccacaccaacggctgtgaaagtcgaaggaatccccacctggatccatgcatcccacgttaagccggcgccacctcccgattcggggtggaaagccgaaaagactgaaaatccccttaagcttcgcctccatcgcgtggttccttactctgtcaataactcctcaagttaatggtaaacgccttgtggacagcccgaactcccataaacccttatctctcacctggttacttactgactccggtacaggtattaatattaacagcactcaaggggaggctcccttggggacctggtggcctgaattatatgtctgccttcgatcagtaatccctggtctcaatgaccaggccacaccccccgatgtactccgtgcttacgggttttacgtttgcccaggacccccaaataatgaagaatattgtggaaatcctcaggatttcttttgcaagcaatggagctgcgtaacttctaatgatgggaattggaaatggccagtctctcagcaagacagagtaagttactcttttgttaacaatcctaccagttataatcaatttaattatggccatgggagatggaaagattggcaacagcgggtacaaaaagatgtacgaaataagcaaataagctgtcattcgttagacctagattacttaaaaataagtttcactgaaaaaggaaaacaagaaaatattcaaaagtgggtaaatggtatgtcttggggaatagtgtactatggaggctctgggagaaagaaaggatctgttctgactattcgcctcagaatagaaactcagatggaacctccggttgctataggaccaaataagggtttggccgaacaaggacctccaatccaagaacagaggccatctcctaacccctctgattacaatacaacctctggatcagtccccactgagcctaacatcactattaaaacaggggcgaaactttttaacctcatccagggagcttttcaagctcttaactccacgactccagaggctacctcttcttgttggctttgcttagcttcgggcccaccttactatgagggaatggctagaggagggaaattcaatgtgacaaaggaacatagagaccaatgtacatggggatcccaaaataagcttacccttactgaggtttctggaaaaggcacctgcatagggatggttcccccatcccaccaacacctttgtaaccacactgaagcctttaatcgaacctctgagagtcagtatctggtacctggttatgacaggtggtgggcatgtaatactggattaaccccttgtgtttccaccttggttttcaaccaaactaaagacttttgcgttatggtccaaattgtcccccgggtgtactactatcccgaaaaagcagtccttgatgaatatgactatagatataatcggccaaaaagagagcccatatccctgacactagctgtaatgctcggattgggagtggctgcaggcgtgggaacaggaacggctgccctaatcacaggaccgcaacagctggagaaaggacttagtaacctacatcgaattgtaacggaagatctccaagccctagaaaaatctgtcagtaacctggaggaatccctaacctccttatctgaagtggttctacagaacagaagggggttagatctgttatttctaaaagaaggagggttatgtgtagccttaaaagaggaatgctgcttttatgtggatcattcaggagctatcagggactccatgagcaagctcagagaaaggttagaaaaacgtcacaaagaaaaagaggctggccaaggatggtttgagggatggttcaacaagtccccatgggtgaccaccctgctttctgctctaacaggacccctagtaatactgctcctgttgcttacagttgggccttgcttaattaatcggtttgttgcctttgttagagaacaagtgagtgcagttcggatcatggtacttagacagcagtaccaaggccttccaagctaaggagaaactgacctttagccttcctagttctaagattagaactattaacaagagaagaagtggggaatgaaaggatgaaaatgcaacctgactctcccagaacccaggaagttaataagaagctctaaatgccctcgaattccagaccctgttccctataggtaaaagatcatactttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcataagataaaaagaggagaagtcaattgcctaacggaccccagtaagatcgggcgtgccacaaaatgttgaaaatcctgataaatatatcttggtgacaatatgtctcccccacccagagacaggcacaaacatgtaactccagaacaacttaaaattaattggtccacaaagcgcgggctctcgaagttttgaattgactggtttgcgatattttaaaaatgattagtttgtaaaagcgcgggctttgttgtgaaccccataaaagctgtcccgactccacactcggggccgcagtcctctacccctgcgtggcgtacgactgtgggccccagcgcgctcggaataaaatcctcttgctgtttgcatcaagaccgcttctcgtgagtgatttggggtgtcgcctcttccgagtcaggacgagagggattttaactcgactggcctttcagtagctccttcttggtgtatggtaaagtgtgtattcaaatcagccaaaggctgtcctcaactgcatcccacacccaacgacctgaggcaattcttgcacctccgctagtcaagctagtcaagcaagcctgccttgttctgatggctttcttgagcaattattaactttcagtgatctctccaaatcccctaagtttccttctttatctatggtcccttattaggacttctacaccttcctgtgcctacttagtccctatcaatgaggtatgtagactgtaagaataaaatgtggtctgctccatgagcaagtgtcattttaaggggctgactgtttttcaggtgaagcaaagatgtagagcatgcacttacagaagatactaaagatacgggataagtaacatgcaggtgattaaaatactttctgaaaatttagccattgtcatcactcaagacaaattttcacaaaatacaacatttggcaggaaaaactgcctgaga

SEQ ID NO: 251 - DNA, 9593 bp, artificial
  5_A sequence
gtctatctcttgtttcagggctgcacccacagcatatggaggttcccaggccaggggtccaattggagctgcagccaccagcctagggtaacagcaatgcaggatcaaagctacctctgagggctacaccagagctcatggcagtaccagatccttaaccccctgagctaggcgagggatcaagcctgcatcctcatggatgccaatcaggtttgttaaccactgaaccataataggaacttcaaagacatttaattattttaaattacaaattaaagacattaaaagtcaattaactttccttgaatatgtggttgtgaaaggatgaaaatgcaacctgaccctcccagaacccaggaagttaataagaagctctaaatgccctcgagttccagaccctgttccctataggtaaaagatcatactttttgctgttttagggcttgctttctgttctgtacaaaactatgtggaaggggaaaaacaggcccctgagtatgtgcctctatgcatgaaacttcttgaaactgcttgagataacaggaaaaagggttcctaactgcttgtttggcttctgtaaagctgcttgcataagataaaaagaggagaagttaatcgcctaaccgaccccagtaagatcggttgctccacaaaatgttgaaaatcctgataaatatatcttggcgacaatatgtctcccccacccagggacaggcacaaacacgtaactccagaacaacttaaaattaattggtccacaaagcgcgggctctcgaagttttgaattgactggtttgtgatattttaaaatgattagtttgtaaaagcgcgggctttgttgtgaaccccataaaagctgtcgcgactccacactcggggccgcagtcctctacccctgcgtggcgtacgactgtgggccccagcgcgctcggaataaaaatcctcttgctgtttgcatcaagaccgcttctcgtgagtgatttggggtgttgcctcttccgagtccggacgagggggattttcactcgactggcctttcacttggtgcgttggccgggaatcctgtgaccaccccttacacccgagaacccacttggaggtaaagggatcccctttggaacgtgtgtgtgtcggccggcgtctctgttctgagtgtctattctcggtaatgcgtgcttttgctttgcagctgtcctctcagaccgtgaggactggaggactgtgatcagcagacgtgctaggaggatcacaggctgccaccctgggggatgccccgggaggtggggagagccagggacgcctggtggtctccttctgtcggtcagaggaccaagttctgttgttgaagtgaaaacttccccctccgtggccgtccgactcttttgcctgcttgtgggagacgcggacgggtcgtgtgtgtctggatctgttggtttctgttttgtgcatctttgtcttgtgcgtccttgtctacagttttaatatgggacaacccctcttagtttgactctcgaccattggactgaagttaaattcagggctcataatttgtcagttcaggttaagaagggaccttggcagactttctgtgcctctgaatggccgacattcaatgttggatggccatcagaggggacctttaattctgagattatcctggctgttaaagcaattatttttcagactggacccggctctcatcccgatcaggagccctatatccttacgtggcaagatttggcagaggatcctccgccatgggttaaaccatggctgaataaaccaagaaagccaggtccccgaattctggctcttggagagaaaaacaaacactcggctgaaaaagtcaagccctctcctcatatctaccctgagattgaggagccgccggcttggccagaaccccaatctgttcccccacccccttatccggcacagggtgctgcgaggggaccctctgcccctcctggagctccggcggtggagggacctgctgcagggactcggagctggaggggcaccaccccggagcggacagacgagatcgtgacattaccgctgcgcaagtacggccctcccatactggggggccaattgcagcccctccagtattggcccttttcttctgcagatctctataattggaaaactaaccatccccctttttcggaggatccccaacacctcacagggttggtggagtcccttatgttctctcaccagcctacttgggatgattgtcaacagctgctgcagacactcttcacaactgaggagcgagagagaattctgttagaggctagaaaaaatgttcctggggccgacgggcgacccacgcaattgcaaaatgagattgacatgggatttccctgactcaccctggttgggactacaacacggctgaaggtagggagagcttgaaaatctatcgccaggctctggtggcaggtctccggggcgcctcaagacggcccactaatttggctaaggtaagagaggtgatgcagggaccgaatgaacctccctcggtttttcttgagaggctcatggaagccttcaggcggttcaccccttttgaccctacctcggaggcccagaaagcctcagtggccctggccttcataggacaatcggcccaggatatcagaaggaagcttcagagactggaagggttacaggaggctgagttacatgatctagtgaaggaggcagagaaagtgtattacaaaagggagacagaagaagaaagggaacaaagaaaagagagagaaagagaggaaagggaggaaagacgtgatagacggcaagagaagaatttgactaagatcttggccgcagtggttgaaaggaaaagcaatagggaaagagagagagattttaggaaaattaggtcaggccctagacagtcagggaacctgggcaataggaccccactcgacaaggaccaatgtgcatattgtaaagaaaaaggacactgggcaagggactgccctaagaagggaaacaaaggactgaaggtcctagctctggaagaagataaagactagggaagacggggttcggaccccctccccgagcccagggtaactttaaaggtggaggggcaaccagttgagtttctggttgataccggagcgaaacattcagtgctactatagccattaggaaaactaaaagataaaaaatcctgggtgatgggcgccacagggcaacgacagtatccatggactacccgaagaacagttgacttgggagtgggacgggtaacccactcgtttctggtcatcatccctgagtgcccagcacccctcttatgtagagacttactgaccaagatgggagcacaaatttcttttgaacaaggaaaaccagaagtgtctgcaaataacaaacctatcactgtgttgaccctccaattagatgacgaatatcgactatattctcccctagtaaagcctgatcaaaatatacaattctggttggaacagtttccccaagcctgggcagaaaccgcagggatgggtttggcaaagcaagttcccccgcaggttattcaactgaaggccagtgctacaccagtatcagtcagacagtaccccttgagtaaagaagctcaagaaggaattcggccgcatgttcaaagattaatccaacagggcatcctagttcctgtccaatctccctggaatactcccctgctaccggttagaaagcctgggaccaatgactatcgaccagtacaggacttgagagaggtcaataaatgggtgcaggatatacacccaacggtcccgaacccttataacctcttgtgtgctctcccgccccaatggagctggtatacagtattggacttaaaggatgtcttcttctgcctgagattacatcccactagccaaccactttttgcctttgaatggagagatccaggtacgggaagaaccgggcagctcacctggacccgactgccccaagggttcaagaactccccgaccatctttgacgaagccctacacagagacctggccaacttcaggatccaacaccctcaggtgaccctcctccagtacgtggatgacctgcttctggcgggagccaccaaacaggactgcttagaatgtacgaaggcactactgctggaattgtctgacctaggctacagagcctccgctaagaaggcccagatttgcaggagagaggtaacatatttggggtacagtttgtggggtgggcagcgatggctgacgggggcatggaagaaaactgtagtccagataccggccccaaccacagccaaacaagtgagagagttttggggacagctggattttgcagactgtggatcccgcggtttgcgaccttagcagccccactctacccactaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccggggagttttaacccaaaccttaggaccatggaggagacctgttgcctacctgtcaaagaagctcgatcctgtagccagtggttggcccgtatgcctgaaggctatcgcagctgtggccatactggtcaaggacgctgacaaattgactttgggacagaatataactgtaatagccccccatgcgttggagaacatcgttcggcagcccccagaccgatggatgaccaacgtctgcatgacccgctatcaaagcctgcttctcacagagagggtcacgttcgctccacgagccgctctcaaccctgccactcttctgcctgaagagactgatgaaccagtgactcatgattgccatcaactgttaatcgaggagactggggtccgcaaggaccttacagacataccgctgactggagaagtgctgacctggttcactgacggaagcagctatgtggtggaaggtaagaggatggccggggcggcagtggtggacgggacccacacgatctgggccagcagcctgctggaagggacttcagcacaaaaggctgagctcatggccctcacgcaagctttgcagctggccgaagggaaatccatagacatttatacggacagcaggtatgcttttgcgactgcacacgtacacggggccatctataagcaaagggggttgcttacctcagcagggagggaaataaagaacaaagaggaaattctaagcctattagaagccttacatttgccaaaaaggctagctattatacactgtcctggacatcagaaagccaaagatctcatatccagagggaaccagatggctgaccgggttgccaagcaggcagcccagggtgttaaccttctgcctataatagaaatgcccaaagccccagaacccggacgacagtacaccctagaagactggcaagagataaaaaagatagaccagttctctgagactccagaggggacctgctatacctcagatgggaaggaaatcctgccccacaaagaagggttagaatatgtccaacagatacatcgtctaacccacctaggaactaaacacctgcagcagttgatcagaacatccccttatcatgttctgaggctaccaggagtggctgactcggtggtcaaacattgtgtgccctgccagctggttaatgctaatccttccagaatacctccaggaaagagactaaggggaagccacccaggtgctcactgggaagtggacttcactgaggtaaagccggctaaatacggaaacaaatgtctattggcttttgtagacaccttttcaggatgggtagaggcttatcctactaagaaagagacttcaactgtggtggctaaaaaaatactggaggaaatttttccaagatttggaatacctaaggtaatagggtcagacaatggtccaactttcgttgcccaggtaagttagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccttatgaattgctctatgggggaccccccccccggttggcagaaattgcctttgtacatagtgctgatgtactgctttcccagcctttgttctctaggcttaaggcactcgagtaggtgaggcagcgagcatggaagcagctctgggaggcctactcaggaggagacttgcaagttccacatcgcttccaagttggagattcagtctatgttagacgccaccgtgcaggaaacctcgagactcggtggaagggcccttatctcgtacttttgaccacaccaacggctgtaaaagttgaaggaatctccacctagatccatgcatcccacgttaagccggcgccacctcccgattcggggtggagagccgaaaagactgaaaacccccttaagcttcgcctccatcgcttggttccttactctgtaaataactcctcaagttaatggtaaacgcccgaactcccacaaacccttatctctcacctggttacttactgactccagtacaggtattactattaacagcactcaaggggaggctcccttagggacctggtggcctgagttatatgtctgccttcgatcggtaatccctggtctcaacgaccaggccacaccccccgatgtactccgtgcttatgggttttatgtttgcccaggacccccaaataatgaagaatattgtggaaatcctcaggatttcttttgcaagcaatggagctgcgtaacttctaatgatgggaattggaaatggccagtctctcagcaagacagagtaagttactcttttgttaacaatcctaccagttataatcaatttaattaccgccatgggaaatggaaagattggcaacagcaggtacaaaaagatgtacgaaataagcaaataagctgtaatttgttagacctagattacttaaaaataagtttcactgaaaaaggaaaacaagaaaatattcaaaagtgggtaaatggtatgtcttggggaatagtgtactatggaggctctgggagaaggaaaggatctattctaactattcgcctcagaatagaaactcagatggaacctccggttgctataggaccaaataagtgtttggccgaacaaggacctccaatccaagaacagaggccatctcttaacccctctgattacaatacagcctctggatcagtccccactgagcctaacatcactattaaaacaggggcaaaactttttagcctcatccagggagcttttcaagctcttaactccacaactccagaggctacctcttcttgttggctttgcttagcttcaggcccaccttactatgaggaacggctagaggagggaaattcaatgtgacaaaggaacatagagaccaatgtacatggggatcccaaaataagcttacccttactgaggtttctggaaaaggcacctgcatagggagggttcccccatcccaccaacacctttgtaaccacactgaagcctttaatcgaacctctgagagtcagtatctggtacccggttatgacaggtggtgggcatgtaatactggattaaccccttgtgtttccaccctggttttcaaccaaactaaagacttttgcgttatggtccaaattgtcccccgggtgtactactatcccgaaaaagcggtccttgatgaatatgactatagatataatcagccaaaaagagaacccatatccctgacactagctgtaatgctcggattgggagtggctgcaggcgtgggaacaggaacggctgccctaatcacaggaccacaacagctggagaaaggacttagtgacctacatcgaattgtaacggaagatctccaagccctagaaaaatctgtcagtaacctagaggaatccctaacctccttatctgaagtggttctacagaacagaagggggttagatctgttatttctaaaagaaggtgggttatgtgtagccttaaaagaggaatgctgcttttatgtggatcattcgggagctatcagggactccatgagcaagctcagagaaaggttagaaaaacgtcacagagaaaaagaggctggccaaggatggtttgagggatggttcaacaagtccccatgggtgaccaccctgctttctgctctaacaggacccctagtaatactgctcctgttgcttacagttgggtcttgcttaattaatcggtttgttgcctttgttagagaacaagtgagtgcagtttggatcatggtacttagacagcagtaccaaggccttccgagccaaggagaaactgacctttagccttcctagttctaagattagaactattaacaagagaagaagtggggaatgaaaggatgaaaatgcaacctgaccctcccagaacccaggaagttaataagaagctctaaatgccctcaaattccagaccctgttccctataggtaaaagatcatactttttgctgttttagggcttgctttctgttctgtacaaaactatgtggaaggggaaaaacaggcccctgagtatgtgcctctatgcatgaaacttcttgaaactgcttgagataacaggaaaaagggttcctaactgcttgtttggcttctgtaaagctgcttgcataagataaaaagaggagaagttaatcgcctaaccgaccccagtaagatcggttgctccacaaaatgttgaaaatcctgataaatatatcttggcgacaatatgtctcccccacccagggacaggcacaaacacgtaactccagaacaacttaaaattaattggtccacaaagcgcgggctctcgaagttttgaattgactggtttgtgatattttaaaatgattagtttgtaaaagcgcgggctttgttgtgaaccccataaaagctgtcacgactccacactcggggccgcagtcctctacccctgcgtggcatacgactgtgggccccagcgcgctcggaataaaaatcctcttgctgtttgcatcaagaccgcttctcgtgagtgatttggggtgttgcctcttccgagtccagacgagggggattttcacttgactggcctttcagttggaggatgggggttagacatgtgtgacgatgaaagcagagttgaaaggtagtattgaccagaaacatatagaatcattattcataacaaagggtagaaacagcattcatccaatgaaataacagatcaataaagtgcattatatgcataaaatgaaatattattctaccctttaatgaaacaaaaatctaacacattctacaacatgaatgatctttgaaaatattctaccaaagaagccttacagcaaatagacccatattggttgattctgtttatatgagatgactgaagaggaaactacttagaatcagaaagtaaaatagtggtttccagggct

SEQ ID NO: 252 - DNA, 9918 bp, artificial
  6_A sequence
atcagtttgacttggattccacatataagtgagagaatgcagtttttgtctttttgtgtcaggtttatttcacttggaataatgtcttccaagatcattcttgttattgcaaatgagagaatttccttcttctttaaggttgaataatatttcagtgtgtgtgtgatattttctttatatattcatccatcaacacttaagtggtttccatgtcttggctactgtcaataatgctgcaatgaatatggtagtgcagatatttctttaagatcctgttttcatttccttgggctatatactcagaagtgggatagctgaatcaaataaatggtagttctgtttttaatattttgaggaacttccatattattttccttaatccctgtaattactttttcttaagaactcagagttaatgatgatgaattccatctttctctcctttcaaagtattccagcttatggcaagattacattcctccctgactttgtctgtgaattgaaaggatgaaaatgcaacctgactctcccagaacccaggaagttaataagaagctctaaatgccctcgaattccagaccctgttccctataggtaaaagatcatactttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcataagataaaaagaggagaagtcaattgcctaacggaccccagtaagatcgggcgtgccacaaaatgttgaaaatcctgataaatatatcttggtgacaatatgtctcccccacccagagacaggcacaaacatgtaactccagaacaacttaaaattaattggtccacaaagcgcgggctctcgaagttttgaattgactggtttgcgatattttaaaaatgattagtttgtaaaagcgcgggctttgttgtgaaccccataaaagctgtcccgactccacactcggggccgcagtcctctacccctgcgtggcgtacgactgtgggccccagcgcgctcggaataaaaatcctcttgctgtttgcatcaagaccgcttctcgtgagtgatttggggtgtcgcctcttccgagtcaggacgagagggattttaactcgactggcctttcagtttggtgcgttggccgggaaacccgcgactacccctcacacccgagaaccgacttggaggtaaagggatcccctttggaacgtgtgagtgtgtgtgtcggctggcgtctctgttctgagtgtctgttttcggtgatgcgcgctttcggtttgcagctgtcctctcagaccgtaaggactgggggactgtgatcagcagacgtgctaggaggatcacaggctgccaccctgggggacgccccgggaggtggggagagccagggacgcctggtggtctccttctgtcggtcagaggaccgagttctgttgttgaagcgaaagcttccccctccgcggccgtccgactcttttgcctgcttgtggaagacgcggacgggtcgcgtgtgtctggatctgttggtttctgttttgtgtgtctttgtcttgtgcgtccttgtctacagttttaatatgggacagacggtgacgacccctcttagtttgactctcgaccattggactgaagttaaatccagggctcataatttgtcagttcaggttaagaagggaccttggcagactttctgtgtctctgaatggccgacatttgatgttggatggccatcagaggggacctttaattctgagattatcctggctgttaaagcaattatttttcagactggacccggctctcatcccgatcaggagccctatatccttacatggcaagatttggcagaggatcctccgccatgggttaaaccttggctgaataagccaagaaagccaggtccccgaattctggctcttggagagaaaaacaaacactcggctgaaaaagtcaagccctctcctcatatctaccccgagattgaggagccgccggcttggccggaaccccaatctgttcccccacccccttatccggcacagggtgctgcgaggggaccctctgcccctcctggagctccggcggtggagggacctgctgcagggactcggagccggaggggcgccaccccggagcggacagacgagatcgcgacattaccgctgcgcacgtacggccctcccataccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaacttggctaaggtaagagaggtgatgcagggaccgaatgaacctccctcagtttttcttgagaggctcatggaagccttcaggcggttcaccccttttgatcctacctcggaggctcagaaagcctcagtggccctggccttcataggacagtcagccctggatatcagaaagaagcttcagagactggaagggttacaggaggctgagttacgtgatctagtgaaggaggcagagaaagtgtattacaaaagggagacagaagaagaaagggaacaaagaaaagagagagaaagagaggaaagggaggaaagacgtaataaacggcaagagaagaatttgactaagatcttggctgcagtggttgaagggaaaagcaatagggaaagagagagagattttaggaaaattaggtcaggccctagacagtcagggaacctgggcaataggaccccactcgacaaggaccaatgtgcatattgtaaagaaaaaggacactgggcaagggactgccccaagaagggaaacaaaggactgaaggtcttagctctggaagaagataaagactagggaagacggggttcggaccccctccccgagcccaggataactttaaaggtggaggggcaaccagttgagtttctggttgataccggagcgaaacattcagtgctactacagccattaggaaaactaaaagataaaaaatcctgggtgatgggtgccacagggcaacaacagtatccatggactacccgaagaacagttgacttgggagtgggacgggtaacccactcgtttctggtcatacctgagtgcccagcacccctcttaggtagagacttactgaccaagatgggagcacaaatttcttttgaacaagggaaaccagaagtgtctgcaaataacaaacctatcactgtgttgaccctccaattagatgacgaatatcgactatattctcccctagtaaagcctgatcaaaatatacaattctggttggaacagtttccccaagcctgggcagaaaccgcagggatgggtttggcaaagcaagttcccccacaggttattcaactgaaggccagtgctgcaccagtgtcagtcagacagtaccccttgagtaaagaagctcgagaaggaattcggccgcatgttcaaagattaatccaacagggcatcctagttcctgtccaatctccctggaatactcccctgctaccggttagaaagcctgggactaatgactatcgaccagtacaggacttgagagaggtcaataaacgggtgcaggatatacacccaacagtcccgaacccttataacctcttgtgtgctctcccaccccaacggagctggtatacagtattggacttaaaggatgccttcttctgcctgagactacatcccactagccaaccactttttgccttcgaatggagagatccaggtgcgggaagaaccgggcagctcacttggactcgactgccccaagggttcaaaaactccccgaccatctttgacgaagccctacacagagacctggccaacttcaggatccaacacccccaggtgaccctcctccagtacgtggatgacctgcttctggcgggagccaccaaacaggactgcttagaaggtacgaaggcactactgctggaattgtctgacctaggctacagagcctccgctaagaaggcccagatttgcaggagagaggtaacatacttggggtacagtttgcggggcgggcagcgatggctgacggaggcacggaagagaactgtagtccagataccggccccaaccacagccaaacaagtgagagagtttttggggacagctggattttgcagactgtggatcccggggtttgcgaccttagcagccccactctacccactaaccaaagaaaaaggggaattctcctgggctcctgagcaccagaaggcatttgatgctatcaaaaaggccctgctgagcgcacctgctctggccctccctgacgtgactaaaccctttaccctttatgtggatgagcgtaagggagtagcccggggagttttaacccaaactctaggaccatggaggagacctgttgcctacctgtcaaagaagctcgatcctgtagccagtggttggcccgtatgcctgaaggctatcgcagctgtggccatactggtcaaggacgctgacaaattgactttgggacagaatataactgtaatagccccccatgcgttggagaacatcgttcggcagcccccagaccgatggatgaccaacgcccgcatgacccactatcaaagcctgcttctcacagagagggtcacgttcgctccaccagccgctctcaaccctgccactcttctgcctgaagagactgatgaaccagtgactcatgattgccatcaactattgattgaggagactggggtccgcaaggaccttacagacataccgctgactggagaagtgttaacctggttcactgacggaagcagctatgtggtggaaggtaagaggatggctggggcggcggtggtggacgggacccgcacgatctgggccagcagcctgccggaaggaacttcagcacaaaaggctgagctcatggccctcacgcaagctttgcggctggccgaagggaaatccataaacatttatacagacagcaggtatgcctttgcgactgcacacgtacacggggccatctataagcaaagggggttgcttacctcagcagggagggaaataaagaacaaagaggaaattctaagcctattagaagccttacatttgccaaaaaggctagctattatacactgtcctggacatcagaaagccaaagatcccatatccagagggaaccagatggctgaccgggttgccaagcaggcagcccagggtgttaaccttctgcctatgatagaaacacccaaagccccagaacccggacgacagtacaccctagaagactggcaagaaataaaaaagatagaccagttctctgaaactccggaggggacctgctatacctcagatgggaaggaaatcctgccccacaaagaagggttagaatatgtccaacagatacatcgtctaacccacctaggaactaaacacctgcagcagttggtcagaacatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaagaaaatactggaggaaatttttccaagatttggaatacctaaggtaatagggtcagacaatggtccagctttcgttgcccaggtaagtcagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggtgaggaacacccctggacagtttgggctgaccccctatgaattgctctacgggggaccccccccgttggcagaaattgcctttgcacatagtgctgatgtgctgctttcccagcctttgttctctaggctcaaggcgctcgagtgggtgaggcagcgagcgtggaagcagctccgggaggcctactcaggaggagacttgcaagttccacatcgcttccaagttggagattcagtctatgttagacgccaccgtgcaggaaacctcgagactcggtggaagggaccttatctcgtacttttgaccacaccaacggctgtgaaagtcgaaggaatccccacctggatccatgcatcccacgttaagccggcgccacctcccgattcggggtggaaagccgaaaagactgaaaatccccttaagcttcgcctccatcgcgtggttccttactctgtcaataactcctcaagttaatggtaaacgccttgtggacagcccgaactcccataaacccttatctctcacctggttacttactgactccggtacaggtattaatattaacagcactcaaggggaggctcccttggggacctggtggcctgagttatatgtctgccttcgatcagtaatccctggtctcaatgaccaggccacaccccccgatgtactccgtgcttacgggttttacgtttgcccaggacccccaaataatgaagaatattgtggaaatcctcaggatttcttttgcaagcaatggagctgcgtaacttctaatgatgggaattggaaatggccagtctctcagcaagacagagtaagttactcttttgttaacaatcctaccagttataatcaatttaattatggccatgggagatggaaagattggcaacagcgggtacaaaaagatgtacgaaataagcaaataagctgtcattcgttagacctagattacttaaaaataagtttcactgaaaaaggaaaacaagaaaatattcaaaagtgggtaaatggtatgtcttggggaatagtgtactatggaggctctgggagaaagaaaggatctgttctgactattcgcctcagaatagaaactcagatggaacctccggttgctataggaccaaataagggtttggccgaacaaggacctccaatccaagaacagaggccatctcctaacccctctgattacaatacaacctctggatcagtccccactgagcctaacatcactattaaaacaggggcgaaactttttagcctcatccagggagcttttcaagctcttaactccacgactccagaggctacctcttcttgttggctttgcttagcttcgggcccaccttactatgagggaatggctagaggagggaaattcaatgtgacaaaggaacatagagaccaatgtacatggggatcccaaaataagcttacccttactgaggtttctggaaaaggcacctgcatagggagggttcccccatcccaccaacacctttgtaaccacactgaagcctttaatcgaacctctgagagtcagtatctggtacctggttatgacaggtggtgggcatgtaatactggattaaccccttgtgtttccaccttggttttcaaccaaactaaagacttttgcgttatggtccaaattgtcccccgggtgtactactatcccgaaaaagcagtccttgatgaatatgactatagatataatcggccaaaaagagagcccatatccctgacactagctgtaatgctcggattgggaatggctgcaggcgtgggaacaggaacggctgccctaatcacaggaccgcaacagctggagaaaggacttagtaacctacatcgaattgtaacggaagatctccaagccctagaaaaatctgtcagtaacctggaggaatccctaacctccttatctgaagtggttctacagaacagaagggggttagatctgttatttctaaaagaaggagggttatatgtagccttaaaagaggaatgctgcttttatgtggatcattcaggagctatcagggactccatgagcaagctcagagaaaggttagaaaaacgtcacaaagaaaaagaggctggccaaggatggtttgagggatggttcaacaagtccccatgggtgaccaccctgctttctgctctaacaggacccctagtaatactgctcctgttgcttacagttgggccttgcttaattaatcggtttgttgcctttgttagagaacaagtgagtgcagttcggatcatggtacttagacagcagtaccaaggccttccaagctaaggagaaactgacctttagccttcctagttctaagattagaactattaacaagagaagaagtggggaatgaaaggatgaaaatgcaacctgactctcccagaacccaggaagttaataagaagctctaaatgccctcgaattccagaccctgttccctataggtaaaagatcatactttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcataagataaaaagaggagaagtcaattgcctaacggaccccagtaagatcgggcgtgccacaaaatgttgaaaatcctgataaatatatcttggtgacaatatgtctcccccacccagagacaggcacaaacatgtaactccagaacaacttaaaattaattggtccacaaagcgcgggctctcgaagttttgaattgactggtttgcgatattttaaaaatgattagtttgtaaaagcgcgggctttgttgtgaaccccataaaagctgtcccgactccacactcggggccgcagtcctctacccctgcgtggcgtacgactgtgggccccagcgcgctcggaataaaaatcctcttgctgtttgcatcaagaccgcttctcgtgagtgatttggggtgtcgcctcttccgagtcaggacgagagggattttaactcgactggcctttcagaatgaaggcagggcctggcatgcaattgtcagcatcctacgttaatatgatattacctctaagtcatcatgtttgttctccttttccctcatactggagttatttggcctacaagagtgtctgggattatactcttggctgagtctggaaataaccttggagaacccaccaaaccagagaggcacatgattcctcatgctgcctttcacagaggccactgagaggctgaaagtattagtcggagatatgggttcaagtcctgactctattccctactgatgtactcttgggcaaatatcaatgtctctgagttttctcatgcaaaagatggaaatagtattatgtacttcacagagtttgagaacaaaaggacataacacaaaagagcattataaactgtaaagaaccacatggacattaattatttactttttatagcagagccatcttattactatctgattagttccctatattgagaattctgaaggtttctatg

SEQ ID NO: 253 - DNA, 9237 bp, artificial
  7_A sequence
catgaacagacattttaatgagaggatatacagatgacaaataagaacataaaaggatcttcaacatcattagccaccacacaaacataaagttaaatcacaatgagacatcactgcacacctgttaggatagttaaaataaaatgtagtgacaaatccaaatgctggtaagaattcagaggaactgtatcacacagacattccagatggaaaacagtttgacagtggtgttgtaatttttcaatatctttactgcagtggtgcatacactgaaaggatgaaaatgcaacctgactctcccagaacccaggaaattaataagaagctctaaatgccctcgaattccagaccctgttccctataggtaaaagatcatactttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcatacgataaaaagaggagaagtcaatcacctaaccgaccccagtaagatcgggtgtgccacaaaatgttgaaaatcctgataaatatatcttggtgacaatatgtctcccccacccagagacaggcacaaacatgtaactccagaacaacttaaaattaattggtccacaaagcgcgggctgtcgaagttttgaattgactggtttgcgatattttaaaatgattagtttgtaaaagcgcgggctttgttgtggaccccataaaagctgtcccgactccacactaagggccgcagtcctctacccctgcgtggcgtacgactgtgggccccagcgcgctcggaataaaaatcctcttgctgtttgcatcaagaccgcttctcgtgagtgatttgggatgtcgcctcttccgagtcaggacgagagggattttcattcgactggcctttcattttggtgcgttggccgagaaacccgcgactacccctcacacccgagaactgacttggaggtaaagggatcccctttggaacatgtgagtgtgtgtgtcggctggcgtctctgttctgagtgtctgttttcggtgatgcgcgctttcggttttcagctgtcctctcagaccgtaaggactgggggactgtgatcagcagacgtgctaggaggatcacaggctgccaccctgggggacgccccgggaggtggggagagccagggacacctggtggtctccttctgtcggtcagaggaccgagttctgttgttgaagcgaaagattccccctccgcggccgtccgactcttttgcctgcttgtggaagacgcggacgggtcgcgtgtgtctggatctgttggtttctgttttgtgtgtctttgtcttgtgcgtccttgtctacagttttaatatgggacagacggtgacgacccctcttagtttgactctcgaccattggactgaagttaaatccagggctcataatttgtcagttcatgttaagaagggaccttggcagactttctgtgcctctgaatggccgacatttgatgttggatggccatcagaggggacctttaattctgagattatcctggctgttaaagcaattatttttcagactggacccggctctcatcctgatcaggagccctatatccttacgtggcaagatttggcagaggatcctccgccatgggttaaaccatggctgaataagccaagaaagccaggtccccgaattctggctcttggagagaaaaacaaacactcggctgaaaaagtcaagccctctcctcatatctaccccgagattgaggagccgccggcttggccggaaccccaatctgttcccccacccccttatccggcacagggtgctgcgaggggaccctctgcccctcctggagctccggaggtggagggacctgctgcagggactcggagctggaggggcgccaccccggagcggacagacgagatcgcgacattaccgctgcgcactacggccctcccataccggggggccaattgcagcccctccagtattggcccttttcttctgcagatctctataattggaaaactaaccatccccctttttcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggctgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaacttggctaaggtaagagaggtgatgcagggactgaatgaacctccctcggtttttcttgagaggctcatggaagccttcaggcggttcaccccttttgatcctacctcggaggcccagaaagcctcagtggccctggccttcataggacagtcagccctggatatcagaaagaagcttcagagactggaagggttacaggaggctgagttacgtgatctagtgaaggaggcagagaaagtgtattacaaaagggagacagaagaagaaagggaacaaagaaaagagagagaaagagaggaaagggaggaaagacgtaataaacggcaagagaagaatttgactaagatcttggctgcagtggttgaagggaaaagcaatagggaaagagagagagattttaggaaaattaggtcaggccctagacagtcagggaacctgggcaataggaccccactcgacaaggaccaatgtgcatattgtaaagaaaaaggacactgggcaagggactgccccaagaagggaaacaaaggactgaaggtcttagctctggaagaagataaagactagggaagacggggtttggaccccctccccgagcccagggtaactttaaaggtggaggggcaaccagttgagtttctggttgataccggagcgaaacattcagtgctactacagccattaggaaaactaaaagataaaaaatcctgggtgatgggtgccacagggcaacgacagtatccatggactacccgaagaacagttgacttgggagtgggacgggtaacccactcatttctggtcatccctgagtgcccagcacccctcttaggtagagacttactgaccaagatgggagcacaaatttcttttgaacaaggaaaaccagaagtgtctgcaaataacaaacctatcactgtgttgaccctccaattagatgacgaatatcgactatattctcccctagtaaagcctgatcaaaatatacaattctggttggaacagtttccccaagcctgggcagaaaccgcagggatgggtttggcaaagcaagttcccccacaggttattcaactgaaggccagtgctacaccagtgtcagtcagacagtaccccttgagtaaagaagctcgagaaggaattcggtcgcatgttcaaagattaatccaacagggcatcctagttcctgtccaatctccctggaatactcccctgctgccggttagaaaagcctgggaccaatgactatcgaccagtacaggacttgagagaggtcaataaacgggtgcaggatatacacccaacagtcccgaacccttataacctcttgtgtgctctcccaccccaacggagctggtatacagtattggacttaaaggatgccttcttctgcctgagactacatcccactagccaaccactttttgccttcgaatggagagatccaggtgcgggaagaaccgggcagctcacttggacccgactgccccaagggttcaaaaactccccgaccatctttgacgaagccctacacagagacctggccaacttcaggatccaacacccccaggtgaccctcctccagtacgtggatgacctgcttctggcgggagccaccaaacaggactgcttagaaggtacgaaggcactactgctggaattgtctgacctaggctacagagcctccgctaagaaggcccagatttgcaggagagaggtaacatacttggggtacagtttgcggggcgggcagcgatggctgacggaggcacggaagaaaactgtagtccagataccggccccaaccacagccaaacaagtgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtgactaaaccctttaccctttatgtggatgagcgtaagggagtagcccggggagttttaacccaaaccctaggaccatggaggagacctgttgcctacctgtcaaagaagctcgatcctgtagccagtggttggcccgtatgcctgaaggctatcgcagctgtggccatactggtcaaggacgctgacaaattgactttgggacagaatataactgtaatagccccccatgcgttggagaacatcgttcggcagcccccagaccgatggatgaccaacgtccgcatgacccactatcaaagcctgcttctcacagagagggtcacgttcgctccaccagctgctctcaaccctgccactcttctgcctgaagaggctgatgaaccagtgactcatgattgccatcaactattgattgaggagactggggtccgcaaggaccttacagacataccgctgactggagaagtgctaacctggttcactgacagaagcagctatgtggtggaaggtaagaggatggctggggcggcggtggtggacgggacccacacgatctgggccagcagcctgccggaagggacttcagcacaaaaggctgagctcatggccctcacgcaagctttgcggctggccgaagggaaatccataaacatttatacggacagcaggtatgcctttgcgactgcacacgtacacagggccatctataagcaaagggggttgcttacctcagcagggagggaaataaagaacaaagaggaaattctaagcctattagaagccttacatttgccaaaaaggctagctattatacactgtcctggacatcagaaagccaaagatcccatatccagagggaaccagatggctgaccgggttaccaagcaggcagcccagggtgttaaccttctgcctataatagaaacacccaaagccccagaacccggacgacagtacaccctagaagactggcaagagataaaaaagatagaccagttctctgagactccggagcggacctgctatacctcagatgggaaggaaatcctgccccacaaagaagggttagaatatgtccaacagatacatcgtctaacccacctaggaactaaacacctgcagcagttggtcagaatatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccggctaaatacggaaacaaatatctattggtttttgtagacacgttttcaggatgggtagaggcttatcctactaagaaagagacttcaaccgtggtggctaagaaaatactggaggaaatttttccaagatttggaatacctaaggtaatagggtcagacaatggtccagctttcgttgcccagataagtcagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccctatgaattgctctacgggggacccccccccccgttggcagaaattgcctttgcacatagtgctgatgtgctgctttcccagcctttgttgtctaggctcaaggtgctcgagtgggtgaggcagcgagcgtggaagcagctccgggaggcctactcaggaggagacttgcaagttccacatcgcttccaagttggagattcagtctatgttagacgccaccatgcaggaaacctcgagactcggtggaagggcccttatctcgtacttttgaccacaccaacggctgtgaaagtcgaaggaatccccacctggatccatgcatcccacgttaagccggcgccacctcccgattcggggtggaaagccgaaaagactgaaaatccccttaagcttcgcctccatcgcgtggttccttactctgtcaataactcctcaagttaatggtaaacgccttgtggacagcccgaactcccataaacccttatctctcacctggttacttactgactccggtacaggtattaatattaacagcactcaagggaaggctcccttagggacctggtggcctgagttatatgtctgccttcgatcagtaatccctggtctcaatgaccaggccacaccccccgatgtactccgtgcttacgggttttatgtttgcccaggacccccaaataatgaagaatattgtggaaatcctcaggatttcttttgcaagcaatggagctgcgtaacttctaatgatgggaattggaaatggccagtctctcagcaagacagagtaagttactcttttgttaacaatcctaccagttataatcaatttaattatggccatgggagatggaaagattggcaacagcgggtacaaaaagatgtacgaaataagcaaataagctgtcattcgttagacctagattacttaaaaataagtttcactgaaaaaggaaaacaagaaaatattcaaaagtgggtaaatggtatgtcttggggaatagtgtactatggaggctctgggagaaagaaaggatctgttctgactattcgcctcagaatagaaactcagatggaacctccgattgctataggaccaaataagggtttggccgaacaaggacctccaatccaagaacagaggccatctcctaacccctctgattacaatacaacctctggatcagtccccactgagcctaacatcactattaaaacaggggcgaaactttttagcctcatccagggagcttttcaagctcttaactccaagactccagaggctacctcttcttgttggctttgcttagcttcgggcccaccttactatgagggaatggctagaggagggaaattcaatgtgacaaaggaacatagagaccaatgtacatggggatcccaaaataagcttacccttactgaggtttctggaaaaggcacctgcatagggagggttcccccatcccaccaacacctttgtaaccacactgaagcctttaatcgaacctctgagagtcaatatctggtacctggttatgacaggtggtgggcatgtaatactggattaaccccttgtgtttccacgttggttttcaaccaaactaaagacttttgtgttatggtccaaattgtcccccgggtgtactactatcccgaaaaagcagtccttgatgaatatgactatagatataattggccaaaaagagaacccatatccctgacactagctgtaatgctcggattgggagtggctgcaggcgtgggaacaggaacggctgccctaatcacaggaccacaacagctggagaaaggacttagtaacctacatcgaattgtaacggaagatctccaagccctagaaaaatctgtcagtaacctggaggaatccctaacctccttatctgaagtggttctacagaacagaagggggttagatctgttatttctaaaagaaggagggttatgtgtagccttaaaagaggaatgctgcttttatgtggatcattcaggagctatcagggactccatgagcaagctcagagaaaggttagaaaaacgtcacaaagaaaaagaggctggccaaggatggtttgagggatggttcaacaagtccccatgggtgaccaccctgctttctgctctaacaggacccctagtaatactgctcctgttgcttacagttgggccttgcttaattaatcggtttgttgcctttgttagagaacaagtgagtgcagttcggatcatggtacttagacagcagtaccaaggccttccaagctaaggagaaactgacctttagccttcctagttctaagattagaactattaacaagagaagaagtggggaatgaaaggatgaaaatgcaacctgactctcccagaacccaggaagttaataagaagctctaaatgccctcgaattccagaccctgttccctataggtaaaagatcatactttttgctattttagggcttgctttctgctctgtacaaaactttgtggaaggggaaaaacaggcccctgagtatgtgcctctatgcttgaaacttcttgaaactgctcctaactgcttgtttggcttctgtaaacctgcttgcatacgataaaaagaggagaagtcaatcgcctaaccgaccccagtaagatcgggtgtgccacaaaatgttgaaaatcctgataaatatatcttggtgacaatatgtctccccacccagagacaggcacaaacatgtaactccagaacaacttaaaattaattggtccacaaagcgcgggctgtcgaagttttgaattgactggtttgcgatattttaaaatgattagtttgtaaaagcgcgggctttgttgtgaaccccataaaagctgtcccgactccacactcggggccgcagtcctctacccctgcgtggcgtacgactgtgggccccagcgcgctcggaataaaaatcctcttgctgtttgcatcaagaccgcttctcgtgagtgatttgggatgtcgcctcttccgagtcaggacgagaggaattttcattcgactggcctttcaacacaaaccctcacagaaaatacaaacatatagtacttaatacacagat

SEQ ID NO: 254 - DNA, 9638 bp, artificial
  8_A sequence
ctttttataaatgtgcaacttataaaatgtctttgtttaaactaccattactaagtttgaatctataaagaatgaaacatttacaaatttagacctaaaatattttctctctactttgtactgtctctctagggagctggaagagatgctaaaggcaacaacctatttaatttatgttctttggaatatcctgtggctaactgaaccttttcagtcttttcatgactcctaccattccttttgaaaggatgaaaatgcaacctgactctcccagaacccaggaagttaataagaagctctaaatgccctcgaattccagaccctgttccctataggtaaaagatcatactttttgctgttttagggcttgctttctgttctgtacaaaactatgtggaaggggaaaaacaggcccctgagtatgtgcctctatgcttgaaacttcttgaaactgctcctaactgcttgtttggcttctgtaaagctgcttgcataagataaaaagaggagaagttaatcgcctaaccgaccccagtaagatcgggtgtgccacaaaatgttgaaaatcctgataaatatatcttggtgacaatatgtctcccccacccagggacaggcacaaacatgtaactccagaacaacttaaaattaattggtccacaaagcgcgggctctcgaagctttgaattgactggtttgtgatattttaaaatgattagtttgtaaaagcgcgggctttgttgtgaaccccataaaagctgtcccgactccacacttggggccgcagtcctctacccctgcgtggcgtacgactgtgggccccagcgcgctcggaataaaaatcctcttgctgtttgcatcaagaccgcttctcctgagtgatttggggtgtcgcctcttccgagtccggacgagagggattttcactcgactggcctttcatttggtgcgttggccgggaaacccgcgactacccctcacacccgagaaccgacttggaggtaaagggatcccctttggaacgtgtgagtgtgtgtgttggctggcgtctctgttctgagtgtctgttttcggtgatgcgcgctttcggtttgcagctgtcctctcagaccgtaaggactgggggactgtgatcagcagacgtgctaggaggatcacaggctgccgccctgggggacgccccgggaggtggggagagccagggacgcctggtggtctccttctgtcggtcagaggaccgagttctgttgttgaagcgaaagcttccccctccgcggccgtccgactcttttgcctgcttgtggaagacgcggacgggtcgcgtgtgtctggatctgttggtttctgttttgtgtgtctttgtcttgtgcgtccttgtctacagttttaatatgggacagacggtgacgacccctcttagtttgactctcgaccattggaatgaagttaaatccagggctcataatttgtcagttcaggttaagaagggaccttggcagaatttctgtgcctctgaatggccgacattcgatgttggatggccatcagaggggacctttaattctgagattatcctggctgttaaagcaattatttttcagactggacccggctctcatcccgatcaggagccctatatccttacatggcaagatttggcagaggatcctccgccatgggttaaaccatggctgaataaaccaagaaagccaggtccccgaattctggctcttggagagaaaaacaaacactcggctgaaaaagtcaagccatatcctcatatctaccccgagattgaggagctgctggcttggccggaaccccaatctgttcccccacccccttatctggcacagggtgctgtgaggggaccctctgcccctcctggagctccggcggtggagggacctgctgcagggactcggagccggaggggcgccaccctggagcggacagacgagatcgcaacattaccgctgcgcacgtacggccctcccataccggggggccaattgcagcccctccagtattggctcttttcttctgcagatctctataattggaaaactaaccatccccctttttcggaggatccccaacgcctcatggggttggtggagtcccttatgttctctcaccagcctacttgggatgattgtcaacagctgctgcagacactcttcacaaccgaggagtgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaacttggctaaggtaagagaggtgaagcagggaccgaatgaacctccctcggtttttcttgagaggctcatggaagccttcaggcggttcaccccttttgatcctacctcggaggcccagaaagcctcagtggccctggccttcataggacagtcagccctggatatcagaaagaagcttcagagactggaagggttacaggaggctgagttacgtgatctagtgaaggaggcagagaaagtgtattacaaaagggagacagaagaagaaagggaacaaagaaaagagagagaaagagaggaaagggaggaaagacgtaataaacggcaagagaagaatttgactaagatcttggccgcagtggttgaagggaaaagcaatagggaaagagagagagattttaggaaaattaggtcaggccctagacagtcagggaacctgggcaataggacctcactcgacaaggaccaatgtgcatattgtaaagaaaaaggacactgggtaagggactgccccaagaagggaaacaaaggactgaaggtcttagctctggaagaagataaagactagggaagacggggttcggaccccctccccgagcccagggtaactttaaaggtggaggggcaaccagttgagtttctggttgataccggagcgaaacattcagtgctactacagccattaggaaaactaaaagataaaaaatcctgggtgatgggtgccacagggcaacgacagtatccatggactacccgaagaacagttgacttgggggtgggacgggtaacccactcgtttctggtcatccctgagtgcccagcacccctcttaggtagagacttactgaccaagatgggagcacaaatttcttttgaacaaggaaaaccagaagtgtctgcaaataacaaacctatcactgtgttgaccctccaattagatgacgaatatcgactatattctcccctaggaaagcctgatcaaaatatacaattctggttggaacagtttccccaagcctgggcagaaaccgcagggatgggtttggcaaagcaagttcccccacaggttattcaactgaaggccagtgctacaccagtgtcagtcagacagtaccccttgagtaaagaagctcgagaaggaattcggccgcatgttcaaagattaatccaacagggcatcctagttcctgtccaatctccctggaatactcccctgctaccggttagaaagcctgggaccaatgactatcgaccagtacaggacttgagagaggtcaataaacgggtgcaggatatacacccaacagtcccgaacccttataacctcttgtgtgctctcccaccccaacggagctggtataaagtattggacttaaaggatgccttcttctgcctgagactacatcccactagccaaccactttttgccttcgaatggagagatccaggtgcgggaagaaccgggcagctcacctggacccgactgccccaagggttcaaaaactccccgaccatctttgacgaagccctacacagagacctggccaacttcaggatccaacacgctcaggtgaccctcctccagtacgtggatgacctgcttctggtgggagccaccaaacaggactgcttagaaggtacgaaagcactactgctggaattgtctgacctaggctacagagcctccgctaagaaggcccagatttgcaggagagaggtaacatacttggggtacagtttgcagggtgggcagcgatggctgacggaggcacggaagaaaactgtagtccagataccggccccaaccacagccaaacaagtgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtgactaaaccctttaccctttatgtggatgagcgtaagggagtagcccggggagttttaacccaaaccctaggaccatggaggagacctgttgcctacctgtcaaagaagctcgatcctgtagccagtggttggcccgtatgcctgaaggctatcgcagctgtggccatactggtcaaggacgctgacaaattgactttgggacagaatataactgtaatagccccccatgcattggagaacatcgttcggcagcccccagaccgatggatgaccaacgcccgcatgacccactatcaaagcctgcttctcacagagagggtcacgttcgctccaccagccgctctcaaccctgccactcttctgcctgaagagactgatgaatcagtgactcatgattgccatcaactattgattgaggagactggggtccgcaaggaccttacagacataccgctgactggagaagtgctaacctggttcactgacggaagcagctatgtggtggaaggtaagaggatggctggggtggcggtggtggacgggacccgcacgatctgggccagcagcctgccggaagggacttcagcacaaaaggctgagctcatggccctcacgcaagctttggggctggccgaagggaaatccataaacatttatacggacagcaggtatgcctttgcgactgtacacatacacggggccatctataagcaaagggggttgcttacctcagcagggagggaaataaagaacaaagaggaaattctaagcctattagaagccttacatttgccaaaaaggctagctattatacactgtcctggacatcagaaagccaaagatctcatatccagagggaaccagatggctgaccgggttgccaagcaggcagcccagggtgttaaccttctgcctataatagaaatgcccaaagccccagaacccggatgacagtacaccctagaagactggcaagagataaaaaagatagaccagttctctgagactccggaggggacctgctatacctcagatgggaaggaaatcctgccccacaaagaagggttagaatatgtccaacagatacatcgtctaacccacctaggaactaaacacctgcagcagttggtcagaacatccccttatcatgttctgaggctaccaggagtggctgactcggtggtgaaacattgtgtgccctgccagctggttaatgctaatccttccagaatacctccaggaaagagactaaggggaagccacccaggtgctcactgggaagtggacttcactgaggtaaagccggctaaatatggaaacaaatatctatcggtttttgtagacaccttttcaggatgggtagaggcttatcctactaagaaagagacttcaaccgtggtggctaagaaaatactggaggaaatttttccaagatttggaatacctaaggtaatagggtcagacaatggactagctttcgttgcccaggtaagtcagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccctatgaattgctctacggggacccccccccccccggtggcagaaattgcctttgcacatagtgctgatgtgctgctttcccagcctttgttctctaggctcaaggcgctcgagtgggtgaggcagcgagcgtggaagcagctccaggaggcctactcaggaggagacttgcaagttccacatcgcttccaagttggagattcagtctatgttagacgccaccgtgcaggaaacctcgagactcggtggaagggcccttatctcgtacttttgaccacaccaacggctgtaaaagttgaaggaatctccacctggatccatgcatcccacgttaagctggcgccacctcccgattcggggtggaaagccgaaaagactgaaaatccccttaagcttcgcctccatcgcgtggttccttactctgtcaataactcctcaagttaatggtaaacgccttgtggacagcccgaactcccataaacccttatctctcacctggttacttactgactccggtacaggtattaacattaacagcactcaaggggaggctcccttagggacctggtggcctgagttatatgtctgccttcgatcagtaatccctggtctcaatgaccaggccacacgccccgatgtactccgtgcttacgggttttatgtttgcccaggacccccaaataatgaagaatattgtggaaatcctcaggatttcttttgtaagcaatggagctgcataacttctaatgatgggaattggaaatggccagtctctcagcaagacagagtaagttactcttttgttaacaatcctaccagttataatcaatttaattatggccatgggagatggaaagattggcaacagcgggtacaaaaagatgtatgaaataagcaaataagctgtcattcgttagacctagattacttaaaaataagtttcactgaaaaaggaaaacaagaaaatattcaaaagtgggtaaatggtatgtcttggggaatagtgtactatggaggctctgggagaaagaaaggatctgttctgactattcgcctcagaatagaaactcagatggaacctctggttgctataggaccaaataagggtttggccgaacaaggacctccaatccaagaacagaggccatctcctaacccctctgattacaatacaacctctggatcagtccccactgagcctaacatcactattaaaacaggggcgaaactttttagcctcatccagggagcttttcaagctcttaactccactactccagaggctacctcttcttgttggctttgcttagcttcgggcccaccttactatgagggaatggctagaggagggaaattcaatgtgacaaaggaacatagagaccaatgtacatggggatcccaaaataagcttacccttactgaagtttctggaaaaggcacctgcatagggagggttcccccatcccaccaacacctttgtaaccacactgaagcctttaatcaaacctctgagagtcagtatctggtacctggttatgacaggtggtgggcatgtaatactggattaaccccttgtgtttccaccctggttttcaaccaaactaaagacttttgcgttatggtccaaattgtcccccgggtgtactactatcccgaaaaagcggtccttgatgaatatgactatagatataatcggccaaaaagagaacccatatccctgacactagctgtaatgctcggattgggagtggctgcaggcgtgggaacaggaacggctgccctaatcacaggaccacaacagctggagaaaggacttagtgacctacatcgaattgtaacggaagatctccaagccctagaaaaatctgtcagtaacctggaggaatccctaacctccttatctgaagtggttctacagaacagaagggggttagatctgttatttctaaaagaaggagggttatgtgtagccttaaaagaggaatgctgcttttatgtggatcattcaggagctatcagggactccatgagcaagctcagagaaaggttagaaaaacgtcacaaagaaaaagaggctggccaaggatggtttgagggatggttcaacaagtccccatgggtgaccaccctgctttctgctctaacaggacccctagtaatactgctcctgttgcttacagttgggccttgcttaattaatcggtttgttgcctttgttagagaacaagtgagtacagttcggatcatggtacttagacagcagtaccaaggccttccgagctaaggagaaactgacctttagccttcctagttctaagattagaactattaacaagagaagaagtggggaatgaaaggatgaaaatgcaacctgactctcccagaacccaggaagttaataagaagctctaaatgccctcgaattccagaccctgttccctataggtaaaagatcatactttttgctgttttagggcttgctttctgttctgtacaaaactatgtggaaggggaaaaacaggcccctgagtatgtgcctctatgcttgaaacttcttgaaactgctcctaactgcttgtttggcttctgtaaagctgcttgcataagataaaaagaggagaagttaatcgcctaaccggccccagtaagatcgggtgtgccacaaaatgttgaaaatcctgataaatatatcttggtgacaatatgtctcccccacccagggacaggcacaaacatgtaactccagaacaacttaaaattaattggtccacaaagcgcgggctctcgaagctttgaattgactggtttgtgatattttaaaatgattagtttgtaaaagcgcgggctttgttgtgaaccccataaaagctgtcccgactccacacttggggccgcagtcctctacccctgcgtggcgtacgactgtgggccccagcgcgctcggaataaaaatcctcttgctgtttgcatcaagaccgcttctcgtgagtgatttggggtgtcgcctcttccgagtccggacgagagggattttcactggactggcctttcactttggttttatacaggtataatctgtattggagcatgtttaaagctccataggtttagtaagtaatattctaaattcatagaatatggagaattaatttctgaggatatcagataatattttgttaaaatatatactttgccttttagaagaattgcaatgtccaccatggtcttgcattgtggtggctggttgctgacatatggtcaaggatatattgcttgggttggatttaagaatatagactacttggcagagttcaaagggaatgacatgaaatgaaattgcaacctacaacttggatagcatttcaagtctcagaagaaaatatgttgttaatgagatatgatcaatatgatagcttgaagtcttagaagaaataaacttgcattgtaaattaggatcttgaggactccatctgagaaagagcaatgcatgtttaagagaaaatgttttagaactgtttttctcttgggaa

SEQ ID NO: 255 - DNA, 9480 bp, artificial
  333034219_B sequence
gtcaagttaattcaggagttttaataaccagacttttgtgataaagaagtacaaagtctgacagtaggagttatttgtccaagagtacagatttaatatttataaataatcattgcagtttcatacccattatttttcctactactccatggatattttgaaagaaaaaagaaaggctaatacaatggagttactggataaaaccatgttgaatttttttaaagtttttattaaagtatagttgatttacaatgttccttcaatttctgctgtactgccaagtgaaaaacatgttgaattttaatgttgacatccaaatggggtgagtctggattagtaatgctcaataacttggagcgagaaaagccagatcaaatttggaagtgctgctttttttgtttgtttttgtctttgttttcttatagctgcacctacagcatatggaagttcctaggccagggatcaaatccaaggcacagctgtgacctactccatagctgtagcaacactggatccttaacccaccattccacagcaggaactgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggatatgagttgactaattgcttatctggattctgtaaaactgactggcaccatagaagaattgattacacattgacagccctagtgacctatctcaactgcaatctgtcactctgcccaggagcccacgcagatgcggacctccggagctattttaaaatgattggtccacggagcgcgggctctcgatattttaaaatgattggtccacggagcgcgggctctcgatattttaaaatgattggtttgtgacgcacaggctttgttgtgaaccccataaaagctgtcccgattccgcactcagggccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgagggggattgttcttttactggcctttcatttggtgcgttggccgggaagtcctgcgaccaccccttacacccgagaaccgacttggaggtaaagggatcccctttggaacgtgtgtgtgtgtcggccggcgtctctgttctgagtgtctgttttcggtgatgcgcgctttcggtttgcagctgtcctctcagaccgtaaggactggaggactgtgatcagcagatgtgctaggaggatcacaggctgccgccctgggggacgccctgggaggtggggagagccagggacgcctggtggtctcctactgtcggtcagaggaccgagttctgttgttgaagcgaaagcttccccctccgcggccgtccgactcttttgcctgcttgtggaagacgcggacgggtcgcgtgtgtctggatctgttggtttctgtttcgtgtgtctttgtcttgtgcgtccttgtctacagttttaatatgggacagacagtgacgaccccccttagtttgactctcgaccattggactgaagttagatccagggctcataatttgtcagttcaggttaagaagggaccttggcagactttctgtgcctctgaatggccaacattcgatgttggatggccatcagaggggacctttaattctgaaattatcctggctgttaaagcagtcatttttcagactggacccggctctcatcctgatcaggagccctatatccttacgtggcaagatttggcagaagatcctccaccatgggttaaaccatggctaaataaaccaagaaagccaggtccccgaatcctggctcttggagagaaaaacaaacactcggccgaaaaagtcgagccctctcctcgtatctaccccaagatcgaggagccgccgacttggccggaaccccaacctgttcccccacccccttatccagcacagggtgctgtgaggggaccctctgcccctcctggagctccggtggtggagggacctgctgccgggactcggagccggagaggcgccaccccggagcggacagacgagatcgcgacattaccgctgcgcacctatggccctcccatgccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctattgccaggctctggtggcgggtctccggggcgcctcaagacggcccactaatttggctaaggtaagagaggtgatgcagggaccgaacaaacctccctcggtatttcttgagaggctcatggaagccttcaggcggttcaccccttttgatcctacctcggaggcccagaaagcctcagtggccctggccttcattgggcagtcggctctggatatcagaaagaaacttcagagactggaagggttacaggaggctgagttacgtgatctagtgagagaggcagagaaggtgtattacagaagggagacagaagaggagaaggaacagagaaaagaaaaggagagagaagaaagggaggaaagacgtgatagacggcaagagaagaatttgactaagatcttggccgcagtggttgaagggaagagcagcagggagagagagagagattttaggaaaattaggtcaggccctagacagtcagggaacctgggcaataggaccccactcgacaaggaccagtgtgcgtattgtaaagaaaaaggacactgggcaaggaactgccccaagaagggaaacaaaggaccgaaggtcctagctctagaagaagataaagattaggggagacggggttcggaccccctccccgagcccagggtaactttgaaggtggaggggcaaccagttgagttcctggttgataccggagcggagcattcagtgctgctacaaccattaggaaaactaaaagaaaaaaaatcctgggtgatgggtgccacagggcaacggcagtatccatggactacccgaagaaccgttgacttgggagtgggacgggtaacccactcgtttctggtcatccctgagtgcccagtaccccttctaggtagagacttactgaccaagatgggagctcaaatttcttttgaacaaggaagaccagaagtgtctgtgaataacaaacccatcactgtgttgaccctccaattagatgatgaatatcgactatattctccccaagtaaagcctgatcaagatatacagtcctggttggagcagtttccccaagcctgggcagaaaccgcagggatgggtttggcaaagcaagttcccccacaggttattcagctgaaggccagtgctacaccagtatcagtcagacagtaccccttgagtagagaggctcgagaaggaatttggccgcatgttcaaagattaatccaacagggcatcctagttcctgtccaatccccttggaatactcccctgctaccggttaggaagcctgggaccaatgattatcgaccagtacaggacttgagagaggtcaataaaagggtgcaggacatacacccaacggtcccgaacccttataacctcttgagcgccctcccgcctgaacggaactggtacacagtattggacttaaaagatgccttcttctgcctgagattacaccccactagccaaccactttttgccttcgaatggagagatccaggtacgggaagaaccgggcagctcacctggacccgactgccccaagggttcaagaactccccgaccatctttgacgaagccctacacagggacctggccaacttcaggatccaacaccctcaggtgaccctcctccagtacgtggatgacctgcttctggcgggagccaccaaacaggactgcttagaaggtacgaaggcactactgctggaattgtctgacctaggctacagagcctctgctaagaaggcccagatttgcaggagagaggtaacatacttggggtacagtttgcggggcgggcagcgatggctgacggaggcacggaagaaaactgtagtccagataccggccccaaccacagccaaacaagtgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccgaggagttttaacccaaaccctaggaccatggaggagacctgttgcctacctgtcaaagaagcttgatcctgtagccagtggttggcccatatgcctgaaggctatcgcagctgtggccatactggtcaaggacgctgacaaattgactttgggacagaatataactgtaatagccccccatgcgttggagaacatcgttcggcagcccccagaccgatggatgaccaacgcccgcatgacccactatcaaagcctgcttctcacagagagggtcacgttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaggatggctggggcggcggtggtggacgggacccgcacgatctaggccagcagcctgccggaaggaacttcagcgcaaaaggctgagctcatggccctcacgcaagctttgcggctggccgaagggaaatccataaacatttatacggacagcaggtatgcctttgcgactgcacacgtacacggggccatctataaacaaagggggttgcttacctcagcagggagggaaataaagaacaaagatgaaattctaagcctattagaagccttacatttgccaaaaaggctagctattatacactgtcctggacatcagaaagccaaagatctcatatctagagggaaccagatggctgaccgggttgccaagcaggcagcccaggctgttaaccttctgcctataatagaaacgcccaaagccccagaacccagacgacagtacaccctagaagactggcaagagataaaaaagatagaccagttctctgagactccggaggggacctgctatacctcatatgggaaggaaatcctgccccacaaagaagggttagaatatgtccaacagatacatcgtctcacccacctaggaactaaacacctgtagcagttggtcagaacatccccttatcatgttctgaggctaccaggagtggctgactcggtggtcaaacattgtgtgccctgccagctggttaatgctaatccttccaaagtacctccagggaagagactaagggggagccacccaggcgctcactgggaagtggacttcactgaagtaaagccggctaaatacggaaacaaatacctattggtttttgtagacaccttttcaggatgggtagaggcttatcctactaagaaagagacttcaaccgtggtggctaaaaaaatactggaggaaatttttccgagatttggaatacctaaggtaatcgggtcagacaatggtccagcttttgttgcccaggtaagtcagggactggccaagatattggggattgattggaaactgcattgtgcatacagaccccaaagctcaggacaggtagagaggatgaatagaaccattaaagagaccctcaccaaattgaccacagagactggcattaatgattggatagctctcctgccctttgtgctttttagggttaggaacacccctggacagtttgggctgaccccctatgaattgctctacgggggaccccccccgttggtagaaattgcttctgtacatagtgctgatgtgctgctttcccagcctttgttctctaggctcaaggcgctcgagtgggtgaggcagcgagcgtggaagcagctccgggaggcctactcaggagaaggagacttgcaagttccacatcgcttccaagtgggagattcagtctatgttagacgccaccgtgcaggaaacctcgagactcggtggaagggcccttatctcgtacttttgaccacaccaacggctgtgaaagtcgaaggaatctccacctggatccatgcatcccacgttaagctggcgccacctcccgactcggggtggagagccgaaaagactgagaatccccttaagcttcgcctccatcgcctggttccttactctaacaataactccccaggccagtagtaaacgccttatagacagctcgaacccccatagacctttatcccttacctggctgattattgaccctgatacgggtgtcactgtaaatagcactcgaggtgttgctcctagaggcacctggtggcctgaactgcatttctgcctccgattgattaaccccgctgttaaaagcacacctcccaacctagtccgtagttatgggttctattgctgcccaggcacagagaaagagaaatactgtgggggttctggggaatccttctgtaggagatggagctgcgtcacctccaacgatggagactggaaatggccgatctctctccaggaccgggtaaaattctcctttgtaaattccggcccgggcaagtacaaagtgatgaaactatataaagataagagctgctccccatcagacttagattatctaaagataagtttcactgaaaaaggaaaacaggaaaatattcaaaagtggataaatggtatgagctggggaatagttttttataaatatggcgggggagcagggtccactttaaccattcgccttaggatagagacggggacagaaccccctgtggcagtgggacccgataaagtactggctgaacaggggcccccggccctggagccaccgcataacttgccggtgccccaattaacctcgctgcggcctgacataacacagccgcctagcaacggtaccactggattgattcctaccaacacgcctagaaactccccaggtgttcctgttaagacaggacagagactcttcagtctcatccagggagctttccaagccatcaactccaccgaccctgatgccacttcttcttgttggctttgtctatcctcagggcctccttattatgaggggatggctaaagaaggaaaattcaatgtgaccaaagagcgtagaaatcaatgtacatgggggtcccgaaataagcttaccctcactgaagtttccgggaaggggacatgcataggaaaagctcccccatcccaccaacacctttgctatagtactgtggtttatgagcaggcctcagaaaatcagtatttagtacctggttataacaggtggtgggcatgcaatactgggttaaccccctgtgtttccacctcagtcttcaaccaatccaaagatttctgtgtcatggtccaaatcgtcccccgagtgtactaccaccctgaggaagtggtccttgatgaatatgactatcggtataaccgaccgaaaagagaacccgtatcccttaccctagctgtaatgctcggattagggacggccgttggcataggaacagggacagctgccctgatcacaggaccacagcagctagagaaaggacttggtgagctacatgcggccatgacagaagatctccgagccttagaggagtctgttagcaacctagaagagtccctgacttctttgtctgaagtggttctacagaaccggaggggattagatctgctgtttctaagagaaggtgggttatgtgcagccttaaaagaagaatgttgcttctatgtagatcactcaggagccatcagagactccatgagcaagcttagagaaaggttagagaggcgtcgaagggaaagagaggctgaccaggggtggtttgaaggatggttcaacaggtctccttggatgaccaccctgctttctgctctgacgggacccctagtagtcctgctcctgttacttacagttgggccttgcttaattaataggtttgttgcctttgttagagaacgagtgagtgcagtccagatcatggtacttaggcaacagtaccaaggccttctgagccaaggagaaactgacctctagccttcccagttctaagattagaactattaacaagacaagaagtggggaatgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaattgcttatctggattctgtaaaactgactggcaccatagaagaattgattacacattgacagccctagtgacctatctcaactgcaatctgtcactctgcccaggagcccacgcagatgcggacctccggagctattttaaaatgattggtccacggagcgcgggctctcgatattttaaaatgattggtccacggagcgcgggctctcgatattttaaaatgattggtccacggagcgcgggctctcgatattttaaaatgattggtttgtgacgcacaggctttgttgtgaaccccataaaagctgtcccgattccgcactcagggccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgagggggattgttcttttactggcctttcagaactcctggaagcattggttttcttcctagtgcacctggctataatcttggacaagttagttgatttttctaagttttagaattgttgttaggtaaatatgaattattaaaatgtattcccctaatttatatagtg

SEQ ID NO: 256 - DNA, 9404 bp, artificial
  333034216_B sequence
caaaaaaaaatcaaaaaacagacaaaaaaaacaacccaatgttccttcaatttctgctgttcagcaaagtgacccagtcacacatatatgcacattctttttttatactatcttccatcatgttctgaaatgatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgacagccctagtgacctatctcaactgcaatctgtcactctgcccaggagcccacgcagatgcggacccccggagctattttaaaatgattggtccacggagcgcgggctctcgatattttaaaatgattggtttgtgacgcacaggctttgttgtgaaccccataaaagctgtcccgattccgcactcagggccgcagtcctctacccctgcgtggtgtacaactgtgggccccagcgcgcttggaataaaaatcctcttgctgtttgcatcaagaccgcttctcgtggagttcccgtcgtggcgcagtggttaacgaacccgactaggaaccatgatgttgcgggttcggtccctgcccttgctcagtgggttaacgatccggcgttgccgtgagctgtggtgtaggttgcagacgcggctcggatcccacgttgctgtggctctggcgtaggccggtggctacagctccgattcgacccctagcctgggaacctccatatgccgcgagagcggcccaagaaaatggcaaaaagacaaaaaaaaaaaaaaaaaaaaaaaaagaccgcttctcgtgagtggtttggggtgtcgcctcttccgagcccggacgagggggattgttcttttactggcctttcatttggtgcattggccggtaagtcctgcgaccaccccttacacccaagaaccgacttggaggtaaagggatcccctttggaacgtgcgtgtgtgtcggccggcgtctctgttctgagtgtctgttttcggtgatgcgcgcttttggtttgcagctgtcctctcagaccgtaaggactggaggactgtgatcagcagacgtgctaggaggatcacaggctgccgccctgggggacgccctgggaggtggggagagccagggacgcctgtctcctactgtcggtcagaggaccgagttctgttgttgaagcgaaagcttccccctccgcggccgtccgactcttttgcctgcttgtggaagacgcggacgggtcgcgtgtgtctggatctgttggtttctgtttcatgtgtctttgtcttgtgcgtccttgtctacagttttaatatgggacagacagtgacgaccccccttagtttgactctcaaccattggactgaagttagatccagggatcataatttgtcagttcaggttaagaagggaccttggcagactttctgtgcctctgaatggccaacattcgatgttggatggccatcagaggggacctttaattctgaaattatcctggctgttaaagcaataatttttcagactggacccggctctcatcctgatcaggagccctatatccttacgtggcaagatttggcagaagatcctccgccatgggttaaaccatggctaaataaaccaagaaagccaggtccccgaatcctggctcttagagagaaaaacaaacactcggccgaaaaagtcgagccctctcctcgtatctaccccgagatcgaggagccgccgacttggccggaaccccaacctgttcccccacccccttatccagcacagggtgctgcgaggggaccctctgcccctcctggagctccggtggtggagagacctgctgccgggactcggagccggagaggcgccaccccggagcggacagacgagatcgcgatattaccactgcgcacctatggccctcccatgccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagtgagagagaattctgttagaggctagaaaaaatgttcctggggccgacgggtgacccacgcagttgcaaaatgagattgacatgggatttcccttgactcgccccggttgggactacaacacggctgaaggtagagagagcttgaaaatctatcgccaggctctggtggcgggtctccggggcgcctcaagatggcccactaatttggctaaggtaagagaggtgatgcagggaccgaacgaacctccctcggtatttcttgagaggctcatggaagccttcaggcggttcaccccttttgatcctacctcggaggcccagaaagcctcagtggccctggccttcattgggcagtcggctctggatatcagaaagaaacttcagagactggaagggttacaggaggctgagttacatgatctagtgagagaggcagagaaggtgtattacagaagggagacagaagaggagaaggaacagagaaaagaaaaggagagagaagaaagggaggaaagacgtgatagacggcaagagaagaatttgactaagatcttggccgcagtggttgaagggaagagcagcagggggagagagagagattttaggaaaattaggtcaggccctagacagtcagggaacctgggcaataggaccccactcgacaaggaccagtgtgcgtattgtaaagaaaaaggacactgggcaaggaactgccccaagaagggaaacaaaggaccgaaggtcctagctctagaagaagataaagattaggggagacggggttcggaccccctccccgagcccagggtaactttgaaggtggaggggcaaccagttgagttcctggttgataccggagcagagcattcagtgctgctacaaccattaggaaaactaaaagaaaaaaaatcctgggtgatgggtgccacagggcaacggcagtatccatggactacctgaagaaccgttgacttgggagtgggacgggtaacccactcatttctggtcatccctgagtgcccagtaccccttctaggtagagacttactgaccaagatgggagctcaaatttcttttgaacaaggaagaccagaagtgtctgcgaataacaaacccatcactgtgttgaccctccaattagatgatgaatatcgactatattctccccaagtaaagcctgatcaagatatacagtcctggttggagcagtttccccaagcctgggcagaaaccgcagggatgggtttggcaaagcaagttcccccacaggttattcagctgaaggccagtgctacaccagtatcagtcagacagtaccccttgagtagagaggcttgagaaggaatttggccgcatgttcaaagattaatccaacagggcatcctagttcctgtccaatccccttggaatactcccctgctaccggttaggaagcctgggaccaatgattatcgaccagtacaggacttgagagaggtcaataaaagggtgcaggacatacacccaacggtcccgaacccttataacctcttgagcgccctcccgcctgaacggaactggtacacagtattggacttaaaagatgccttcttctgcctgagattacaccccactagccaaccactttttgccttcgaatggagagatccaggtacgggaagaaccgggcagctcacctggacccgactgccccaagggttcaagaactccccgaccatctttgacgaagccctccacagagacctggccaacttcaggatccaacaccctcaggtgaccctcctccagtacgtggatgacctgcttctggcgggagccaccaaacaggactgcttagaaggtacgaaggcactactgctggaattgtctgacctaggctacagagcctccgctaagaaggcccagatttgcaggagagaggtaacatacttggggtacagtttgcggggcgggcagcgatggctgacggaggcacggaagaaaactgtagtccagataccggccccaaccacagccaaacaagtgagagagtttttggggacagctggattttgcagactgtggatcccagggtttgcgaccttagcagccccactctaccagctaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccggggagttttaacccaaaccctaggaccatggaggagacctgttgcctacctgtcaaagaagctcgatcctgtagccagtggttggcccgtatgcctgaaggctatcgcagctgtggccatactggtcaaggacgctgacaaattgactttgggacagaatataactgtaatagccccccatgcattggagaacatcgttcggcagcccccagaccgatggatgaccaacgcccgcatgacccactatcaaagcctgcttctcacagagagggtcacgttcgctccaccagccactctcaaccctgccactcttctgcctgaagagactgatgaaccagtgactcatgattgccatcaactattgattgaggagactggggtccacaaggaccttacagacataccgctgactggagaagtgctaacctggttcactgacggaagcagttatgtggtggaatgtaagaggatggctggggcggcggtggtggacgggacccgcacgatctgggccagcagcctgccggaaggaacttcagcgcaaaaggctgagctcatggccctcacgcaagctttgcggctggccgaagggaaatccataaacatttatacggacagcaggtatgcttttgcaactgcacacgtacacggggccatctataaacaaagggggttgtttacctcagcagggagggaaataaagaacaaagaggaaattctaagccttttagaagccttacatttgccagaaaggctagctattatacactgtcctggacatcagaaagccaaagatctcatatctagagggaaccagatggctgaccgggttgccaagcaggcagcccagggtgttaaccttctgcctataatagaaacgcccaaagccccagaacccagacgacagtacaccctagaagactggcaagagataaaaaagatagaccagttctctgagactccggaggggacctgctatacctcatatgggaaggaaatcctgccccacaaagaagggttagaatatgtccaacagaaacatcgtctcacccacctaggaactaaacacctgcagcagttggtcagaacatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaaaaaaatactggaggaaatttttccgagatttggaatacctaaggtaatcgggtcagacaatggtccagcttttgttgcccaggtaagtcagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccctatgaattgctctacgggggacccccccccccgttggtagaaattgcttctgtacatagtgttgatgtgctgctttcccagcctttgttctctaggctcaaggcgctcgagtgggtgaggcaacgagcgtggaagcagctccgggaggcctactcaggagaaggagacttgcaagttccacatcgcttccaagtgggagattcagtctatgttagacgccaccgtgcaggaaacctcgagactcggtggaagggcccttatctcgtacttttgaccacaccaacggctgtgaaagtcgaaggaatctccacctggatccatgcatcccacgttaagctggcgccacctcccgactcggggtggagagccgaaaagactgagaatccccttaagcttcgcctccatcgcctggttccttactctaacaataactccccaggccagtagtaaacgccttatagacagctcgaacccccatagacctttatcccttacctggctgattattgaccctgatacgggtgtcactgtaaatagcactcgaggtgttgctcctagaggcacctggtggcctgaactgcatttctgcctccgattgattaaccccgctgttaaaagcacacctcccaacctagtccgcagttatgggttctattgctgcccaggcacagagaaagagaaatactgtgggggttccggggaatccttctgtaggagatggagctgcgtcacctccaacgatggagactggaaatggccgatctctctccaggaccgggtaaaattctcctttgtcaattccggcccgggcaagtacaaagtgatgaaactatataaagataagagctgctccccatcagacttagattatctaaagataagtttcactgaaaaaggaaaacaggaaaatattcaaaagtggataaatggtatgagctggggaatagttttttataaatatggcgggggagcagggtccactttaaccattcgccttaggatagagacggggacagaaccccctgtggcagtgggacccgataaagtactggctgaacaggggcccccggccctggagccaccgcataacttgccggtgccccaattaacctcgctgcggcctgacataacacagccgcctagcaacggtaccactggattgattcctaccaacacgcctagaaactccccaggtgttcctgttaagacaggacagagactcttcagtctcatccagggagctttccaagccatcaactccaccgaccccgatgccacttcttcttgttggctttgtctatcctcagggcctccttattatgaggggatggctaaagaaggaaaattcaatgtgaccaaagagcatagaaatcaatgtacatgggggtcccgaaataagcttaccctcactgaagtttccgggaaggggacatgcataggaaaagctcccccatcccaccaacacctttgctatagtactgtggtttatgagcaggcctcagaaaatcagtatttagtacctggttataacaggtggtgggcatgcaatactgggttaaccccctgtgtttccacctcagtcttcaaccaatccaaagatttctgtgtcatggtccaaatcatcccccgagtgtactaccatcctgaggaagtggtccttgatgaatatgactatcggtataaccgaccgaaaagagaacccgtatcccttaccctagctgtaatgctcggattagggacggccgttggcgtaggaacagggacagctgccctgatcacaggaccacagcagctagagaaaggacttggtgagctacatgcgaccatgacagaagatctctgagccttagaggagtctgttagcaacctagaagagtccctgacttctttgtctggagtggttctacagaaccggaggggattagatctgctgtttctaagagaaggtgggttatgtgcagccttaaaggaagaatgttgcttctatgtagatcactcaggagccatcagagactccatgaggaagcttagagaaaggttagagaggcgtcgaagggaaagagaggctgaccaggggtggtttgaaggatggttcaacaggtctccttggatgaccaccctgctttctgctctgacgggacccctagtagtcctgctcctgttacttacagttgggccttgcttaattaataggtttgttgcctttgttagagaacgagtgagtgcagtccagatcatggtacttaggcaacagtaccaaggccttctgagccaaggagaaactgacctctagccttcccagttctaagattagaactactaacaagagaagaagtggggaatgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgacagccctagtgacctatctcaactgcaatctgtcactctgcccaggagcccacgcagatgcggacctccggagctattttaaaatgattggtccacggagcacgggctctcgatattttaaaatgattggtccacggagcgcgggctctcgatattttaaaatgattggtttgtgacgcacaggctttgttgtgaaccccataaaagctgtcccgattccgcactcgggccgcagtcctctacccctgcgtggtgtacaactgtgggccccagcgcgcttggaataaaaatcctcttgctgtttgcatcaagaccgcttctcgtgagtggtttggggtgtcgcctcttccgagcccggacgagggggattgttcttttactggcctttcagttcaaacccgagaaattagacagagttcctgtgctgtgcagtagaaccccattgcttatccatttcaaatcttattttttaaatataaacatttaacactatttgcttcagatctcacattttatacagatttgaaatattactgatataatttgccttttatggcacctcatgctccatcccacttctgaaatccaggaggagcctatggtaccctcccaaggacaaaagcctttctgtgtcctccatttcctgtatgaagggaaaat

SEQ ID NO: 257 - DNA, 9082 bp, artificial
  333034212_B sequence
tcacagactgcacatggaaattgaaatcaagccaggaaaaccccaatttttcacctgcctgtcacttcgcagacattccaagcgcggggtctgtcttccggggcctgggccctctgccttccttccatcatcttagagcaggtgctctcagactgcccttggcttgcatagctcgtgtcgtacttccagtgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgacagccctagtgacctatctcaactgcaatctgtcactctgcccaggagcccacgcagatgcggacctccggagctattttaaaatgattggtccacggagcgcgggctctcgatattttaaaatgattggtccacggagcgcgggctctcgatattttaaaatgattggtttgtgacgcacaggctttgttgtgaaccccataaaagctgtcccgattccgcactcggggcccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgagggggattgttcttttactggcctttcatttggtgcattggccgggaaaccctgcgaccaccccttacacccgagaaccgacttggaggtaaagggatcccctttggaacttgtgtgtgtgtcggccggcgtctctgttctgagtgtctgttttcggtgatgcgcgctttcggtttgcagctgtcctctcagaccgtaaggactggaggactgtgatcagcagacgtgctaggaggatcacaggctgccaccctgggggacgccccgggaggtggggagagccagggacgcctggtggtctcctactgtcggtcagaggaccgagttctgttgttgaagcgaaagcttccccctccgcggccgtccgactcttttgcctgcttgtggaagacgcggacgggtcgcgtgtgtctggatctgttggtttctgtttcgtgtgtctttgtcttgtgcgtccttgtctacagttttaatatgggacagacagtgacgaccccccttagtttgactctcgaccattggactgaagttagatccagggctcataatttgtcagttcaggttaagaagggaccttggcagactttctgtgcctctgaatggccaacattcgatgttggatggccatcagaggggacctttaattctgaaattatcctggctgttaaggcaatcatttttcagactggacccagctctcatcctgatcaggagccctatatccttacgtggcaagatttggcagaagatcctccgccatgggttaaaccatggctaaataaaccaagaaagccaggtccccgaatcctggctcttggagagaaaaacaaacactcggccgaaaaagtcgagccctctcctcgtatctaccccgagatcgaggagccgccgacttggccggaaccccaacctgttcccccacccccttatccagcacagggtgctgtgaggggaccctctgcccctcctggagctccggtggtggagggacctgctgccgggactcggagccggagaggcgccaccccggagcggacagacgagatcgcgatattaccgctgcgcacctatggccctcccatgccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaatttggctaaggtaagagaggtgatgcagggaccgaacgaacctccctcggtatttcttgagaggctcatggaagccttcaggcggttcaccccttttgatcctacctcggaggcccagaaagcctcagtggccctggccttcattgggcagtcggctctggatatcagaaagaaacttcagagactggaagggttacaggaggctgagttacgtgatctagtgagagaggcagagaaggtgtattacagaagggagacagaagaggagaaggaacagagaaaagaaaaggagagagaagaaagggaggaaagacgtgatagacggcaagagaagaatttgactaagatcttggccgcagtggttgaagggaagagcagcagggagagagagagagattttaggaaaattaggtcaggccctagacagtcagggaacctgggcaataggaccccactcgacaaggaccagtgtgcgtattgtaaagaaaaaggacactgggcaaggaactgccccaagaagggaaacaaaggaccgaaggtcctagctctagaagaagataaagattaggggagacggggttcggaccccctccccgagcccagggtaactttgaaggtggaggggcaaccagttgagttcctggttgataccggagcggagcattcagtgctgctacaaccattaggaaaactaaaagaaaaaaaatcctgggtgatgggtgccacagggcaacggcagtatccatggactacccgaagaaccgttgacttggcagtgggacgggtaacccactcgtttctggtcatccctgagtgcccagtaccccttctaggtagagacttactgaccaagatgggagctcaaatttcttttgaacaaggaagaccagaagtgtctgtgaataacaaacccatcactgtgttgaccctccaattagatgatgaatatcgactatattctccccaagtaaagcctgatcaagatatacagtcctggttggagcagtttccccaagcctgggcagaaaccgcagggatgggtttggcaaagcaagttcccccacaggttattcaactgaaggccagtgctacaccagtatcagtcagacagtaccccttgagtagagaggctcgagaaggaatttggccgcatgttcaaagattaatccaacagggcatcctagttcctgtccaatccccttggaatactcccctgctaccggttaggaagcctgggaccaatgattatcgaccagtacaggacttgagagaggtcaataaaagggtgcaggacatacacccaacggtcccgaacccttataacctcttgagcgccctcccgcctgaacggaactggtacacagtattggacttaaaagatgccttcttctgcctgagattacaccccactagccaaccgctttttgccttcgaatggagagatccaggtacgggaagaaccgggcagctcacctggacccgactgccccaagggttcaagaactccccgaccatctttgacgaagccctacacagggacctggccaacttcaggatccaacaccctcaggtgaccctcctccagtacgtggatgacctgcttctggcgggagccaccaaacaggactgcttagaaggtacgaaggcactactgctggaattgtctgacctaggctacagagcctctgctaagaaggcccagatttgcaggagagaggtaacatacttggggtacagtttgcggggcgggcagcgatggctgacggaggcacggaagaaaactgtagtccagataccggccccaaccacagccaaacaagtgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccgaggagttttaacccaaaccctaggaccatggaggagacctgttgcctacctgtcaaagaagcttgatcctgtagccagtggttggcccgtatgcctgaaggctatcgcagctgtggccatactggtcaaggacgctgacaaattgactttgggacagaatataactgtaatagccccccatgcattggagaacatcgttcggcagcccccagaccgatggatgaccaacgcccgcatgacccactatcaaagcctgcttctcacagagagggtcactttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaggatggctggggcggcggtggtggacgggacccacacgatctgggccagcagcctgccggaaggaacttcagcgcaaaaggctgagctcatggccctcacgcaagctttgcggctggccgaagggaaatccataaacatttatacggacagcaggtatgcctttgcgactgcacacgtacacggggccatctataaacaaagggggttgcttacctcagcagggagggaaataaagaacaaagaggaaattctaagcctattagaagccttacatttgccaaaaaggctagctattatacactgtcctggacatcagaaagccaaagatctcatatctagagggaaccagatggctgaccgggttgccaagcaggcagcccaggctgttaaccttctgcctataatagaaacgcccaaagccccagaacccagacgacagtacaccctagaagactggcaagagataaaaaagatagaccagttctctgagactccggaggggacctgctatacctcatatgggaaggaaatcctgccccacaaagaagggttagaatatgtccaacagatacatcgtctcacccacctaggaactaaacacctgcagcagttggtcagaacatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaaaaaaatactggaggaaatttttccgagatttggaatacctaaggtaatcgggtcagacaatggtccagcttttgttgcccaggtaagtcagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccctatgaattgctctacgggggacccccccccgttggtagaaattgcttctgtacatagtgctgatgtgctgctttcccagcctttgttctctaggctcaaggcgctcgagtgggtgaggcaacgagcgtggaagcagctccgggaggcctactcaggagaaggagacttgcaagttccacatcgcttccaagtgggagattcagtctatgttagacgccaccgtgcaggaaacctcgagactcggtggaagggcccttatctcgtacttttgaccacaccaacggctgtgaaagtcgaaggaatctccacctggatccatgcatcccacgttaagctggcgccacctcccgactcggggtggagagccgaaaagactgagaatccccttaagcttcgcctccatcgcctggttccttactctaacaataactccccaggccagtagtaaacgccttatagacagctcgaacccccatagacctttatcccttacctggctgattattgaccctgatacgggtgtcactgtaaatagcactcgaggtgttgctcctagaggcacctggtggcctgaactgcatttctgcctccgattgattaaccccgctgttaaaagcacacctcccaacctagtccgtagttatgggttctattgctgcccaggcacagagaaagagaaatactgtgggggttctggggaatccttctgtaggagatggagctgcgtcacctccaacgatggagactggaaatggccgatctctctccaggaccgggtaaaattctcctttgtcaattccggcccgggcaagtacaaagtgatgaaactatataaagataagagctgctccccatcagacttagattatctaaagataagtttcactgaaaaaggaaaacaggaaaatattcaaaagtggataaatggtatgagctggggaatagttttttataaatatggcgggggagcagggtccactttaaccatttgccttaggatagagacggggacagaaccccctgtggcagtgggacccgataaagtactggctgaacaggggcccccggccctggagccaccgcataacttgccggtgccccaattaacctcgctgcggcctgacataacacagccgcctagcaacggtaccactggattgattcctaccaacacgcctagaaactccccaggtgttcctgttaagacaggacagagactcttcagtctcatccagggagctttccaagccatcaactccaccgaccctgatgccacttcttcttgttggctttgtctatcctcagggcctccttattatgaggggatggctaaagaaggaaaattcaatgtgaccaagagcatagaaatcaatgtacatgggggtcccgaaataagcttaccctcactgaagtttccgggaaggggacatgcataggaaaagctcccccatcccaccaacacctttgctatagtactgtggtttatgagcaggcctcagaaaatcagtatttagtacctggttataacaggtggtgggcatgcaatactgggttaaccccctgtgtttccacctcagtcttcaaccaatccaaagatttctgtgtcatggtccaaatcgtcccccgagtgtactaccatcctgaggaagtggtccttgatgaatatgactatcggtataaccgaccaaaaagagaacccgtatcccttaccctagctgtaatgctcggattagggacggccgttggcgtaggaacagggacagctgccctgatcacaggaccacagcagctagagaaaggacttggtgagctacatgcggccatgacagaagatctccgagccttagaggagtctgttagcaacctagaagagtccctgacttctttgtctgaagtggttctacagaaccggaggggattagatctgctgtttctaagagaaggtgggttatgtgcagccttaaaagaagaatgttgcttctatgtagatcactcaggagccatcagagactccatgagcaagcttagagaaaggttagagaggcgtcgaagggaaagagaggctgaccaggggtggtttgaaggatggttcaacaggtctccttggatgaccaccctgctttctgctctgacgggacccctagtagtcctgctcctgttacttacagttgggccttgcttaattaataggtttgttgcctttgttagagaacgagtgagtgcagtccagatcatggtacttaggcaacagtaccaaggccttctgagccaaggagaaactgacctctagccttcccagttctaagattagaactattaacaagacaagaagtggggaatgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgaaagccctagtgacgtatctcaactgcaatctgtcactctgcccaggagcccgtgcagatgcggacctccggagctattttaaaatgattggtccacggagcgcgggctctcgatattttaaaatgattggtccacggagcgcgggctctcgatattttaaaatgattggtttgtgacgcacaggctttgttgtgaaccccataaaagctgtcccgattccgcactcggggccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgagggggattgttcttttactggcctttcaccagtcctttcttttcttttctgcctcagcatgtcatccaccggcggaccggatactttgtttatcttgaaactgtgtgttaacatttagcacaacatttaaaggacagttggaatctaaaacaaaattc

SEQ ID NO: 258 - DNA, 8704 bp, artificial
  21064962_B sequence
cccgaattacagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgacagccctagtgacctatctcaactgcaatctgtcactctgcccaggagcccacgcagatgcggacctccggagctattttaaaatgattggtccacggagcgcgggctctcgatattttaaaatgattggtccatggagcgcgggctctcgatattttaaaatgattggtttgtgacgcacaggctttgttgtgaaccccataaaagctgtcccgattccgcactcggggccgcagtcctctacccctgcgtggtgtacgactgtgggccccagcgcgcttggaataaaaatcctcttgctgtttgcatcaagaccgcttcttgtgagtgatttggggtgtcgcctcttccgagcccggacgagggggattgttcttttactggcctttcatttggtgcatgggccgggaaatcctgcgaccaccccttacacccgagaaccgacttggaggtaaagggatcccctttggaacgtgtgtgtgtgtcggccggcgtctctgttctgagtgtctgttttcggtgatgcgcgctttcggtttgcagctgtcctctcagaccgtaaggactggaggactgtgatcagcagacgtgctaggaggatcacaggctgccaccctgggggacgccccgggaggtggggagagccagggacgcctggtggtctcctactgtcggtcagaggaccgagttctgttgttgaagcgaaagcttccccctccgcggccgtccgactcttttgcctgcttgtggaagacgcggacgggtcgcgtgtgtctggatctgttggtttctgtttcgtgtgtctttgtcttgtgcgtccttgtctacagttttaatatgggacagacagtgactaccccccttagtttgactctcgaccattggactgaagttagatccagggctcataatttgtcagttcaggttaagaagggaccttggcagactttctgtgcctctgaatggccaacattcgatgttggatggccatcagaggggacctttaattctgaaattatcctggctgttaaggcaatcatttttcagactggacccggctctcatcctgatcaggagccctatatccttacgtggcaagatttggcagaagatcctccgccatgggttaaaccatggctaaataaaccaagaaagccaggtccccgaatcctggctcttggagagaaaaacaaacactcggccgaaaaagtcgagccctctcctcgtatctaccccgagatcgaggagccgccgacttggccggaaccccaacctgttcccccacccccttatccagcacagggtgctgtgaggggaccctctgcccctcctggagctccggtggtggagggacctgctgccgggactcggagccggagaggcgccaccccggagcggacagacgagatcgcgatattaccgctgcgcacctatggccctcccatgccagggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaatttggctaaggtaagagaggtgatgcagggaccgaacgaacctccctcggtatttcttgagaggctcatggaagccttcaggcggttcaccccttttgatcctacctcagaggcccagaaagcctcagtggccctggccttcattgggcagtcggctctggatatcaggaagaaacttcagagactggaagggttacaggaggctgagttacgtgatctagtgagagaggcagagaaggtgtattacagaagggagacagaagaggagaaggaacagagaaaagaaaaggagagagaagaaagggaggaaagacgtgatagacggcaagagaagaatttgactaagatcttggccgcagtggttgaagggaagagcagcagagagagagagagagattttaggaaaattaggtcaggccctagacagtcagggaacctgggcaataggaccccactcgacaaggaccagtgtgcgtattgtaaagaaaaaggacactgggcaaggaactgccccaagaagggaaacaaaggaccgaaggtcctagctctagaagaagataaagattaggggagacggggttcggaccccctccccgagcccagggtaactttgaaggtggaggggcaaccagttgagttcctggttgataccggagcggagcattcagtgctgctacaaccattaggaaaactaaaagaaaaaaaatcctgggtgatgggtgccacagggcaacggcagtatccatggactacccgaagaaccgttgacttgggagtgggacgggtaacccactcgtttctggtcatccctgagtgcccagtaccccttctaggtagagacttactgaccaagatgggagctcaaatttcttttgaacaaggaagaccagaagtgtctgtgaataacaaacccatcactgtgttgaccctccaattagatgatgaatatcgactatattctccccaagtaaagcctgatcaagatatacagtcctggttggagcagtttccccaagcctgggcagaaaccgcagggatgggtttggcaaagcaagttcccccacaggttattcaactgaaggccagtgctacaccagtatcagtcagacagtaccccttgagtagagaggctcgagaaggaatttggccgcatgttcaaagattaatccaacagggcatcctagttcctgtccaatccccttggaatactcccctgctaccggttaggaagcctgggaccaatgattatcgaccagtacaggacttgagagaggtcaataaaagggtgcaggacatacacccaacggtcccgaacccttataacctcttgagcgccctcccgcctgaacggaactggtacacagtattggacttaaaagatgccttcttctgcctgagattacaccccactagccaaccactttttgccttcgaatggagagatccaggtacgggaagaaccgggcagctcacctggacccgactgccccaagggttcaagaactccccgaccatctttgacgaagccctacacagggacctggccaacttcaggatccaacaccctcaggtgaccctcctccagtacgtggatgacctgcttctggcgggagccaccaaacaggactgcttagaaggtacgaaggcactactgctggaattgtctgacctaggctacagagcctctgctaagaaggcccagatttgcaggagagaggtaacatacttggggtacagtttgcggggcgggcagcgatggctgacggaggcacggaagaaaactgtagtccagataccggccccaaccacagccaaacaagtgagagagtttttggggacagctggattttgcagactgtggatcccggggtttgcgaccttagcagccccactctacccgctaaccaaagaaaaagggggattctcctgggctcctgagcaccagaaggcatttgatgctatcaaaaaggccctgctgagcgcacctgctctggccctccctgacgtaactaaaccctttaccctttatgtggatgagcgtaagggagtagcccgaggagttttaacccaaaccctaggaccatggaggagacctgttgcctacctgtcaaagaagcttgatcctgtagccagtggttggcccgtatgtctgaaggctatcgcagctgtggccatactggtcaaggacgctgacaaattgactttgggacagaatataactgtaatagccccccatgcattggagaacatcgttcggcagcccccagaccgatggatgaccaacgcccgcatgacccactatcaaagcctgcttctcacagagagggtcactttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaggatggctggggcggcagtggtggacgggacccgcacgatctgggccagcagcctgccggaaggaacttcagcgcaaaaggctgagctcatggccctcacgcaagctttgcggctggccgaagggaaatccataaacatttatacggacagcaggtatgcctttgcgactgcacacgtacacggggccatctataaacaaagggggttgcttacctcagcagggagggaaataaagaacaaagaggaaattctaagcctattagaagccttacatttgccaaaaaggctagctattatacactgtcctggacatcagaaagccaaagatctcatatctagagggaaccagatggctgaccgggttgccaagcaggcagcccaggctgttaaccttctgcctataatagaaacgcccaaagccccagaacccagacgacagtacaccctagaagactggcaagagataaaaaagatagaccagttctctgagactccggaggggacctgctatacctcatatgggaaggaaatcctgccccacaaagaagggttagaatatgtccaacagatacatcgtctcacccacctaggaactaaacacctgcagcagttggtcagaacatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaaaaaaatactggaggaaatttttccgagatttggaatacctaaggtaatcgggtcagacaatggtccagcttttgttgcccaggtaagtcagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccctatgaattgctctacgggggaccccccccgttggtagaaattgcttctgtacatagtgctgatgtgctgctttcccagcctctgttctctaggctcaaggcactcgagtgggtgaggcaacgagcgtggaagcagctccgggaggcctactcaggagaaggagacttgcaagttccacatcgcttccaagtgggagattcagtctatgttagacgccaccgtgcaggaaacctcgagactcggtggaagggcccttatctcgtacttttgaccacaccaacggctgtgaaagtcgaaggaatctccacctggatccatgcatcccacgttaagctggcgccacctcccgactcggggtggagagccgaaaagactgagaatccccttaagcttcgcctccatcgcctggttccttactctaacaataactccccaggccagtagtaaacgccttatagacagctcgaacccccatagacctttatcccttacctggctgattattgaccctgatacgggtgtcactgtaaatagcactcgaggtgttgctcctagaggcacctggtggcctgaactgcatttctgcctccgattgattaaccccgctgttaaaagcacacctcccaacctagtccgtagttatgggttctattgctgcccaggcacagaaaaagagaaatactgtgggggttctggggaatccttctgtaggagatggagctgcgtcacctccaacgatggagactggaaatggccgatctctctccaggaccgggtaaaattctcctttgtcaattccggcccgggcaagtacaaagtgatgaaactatataaagataagagctgctccccatcagacttagattatctaaagataagtttcactgaaaaaggaaaacaggaaaatattcaaaagtggataaatggtatgagctggggaatagttttttataaatatggcgggggagcagggtccactttaaccattcgccttaggatagagacggggacagaaccccctgtggcagtgggacccgataaagtactggctgaacaggggcccccggccctggagccaccgcataacttgccggtgccccaattaacctcgctgcggcctgacataacacagccgcctagcaacggtaccactggattgattcctaccaacacgcctagaaactccccaggtgttcctgttaagacaggacagagactcttcagtctcatccagggagctttccaagccatcaactccaccgaccctgatgccacttcttcttgttggctttgtctatcctcagggcctccttattatgaggggatggctaaagaaggaaaattcaatgtgaccaaagagcatagaaatcaatgtacatgggggtcccgaaataagcttaccctcactgaagtttccgggaaggggacatgcataggaaaagctcccccatcccaccaacacctttgctatagtactgtggtttatgagcaggcctcagaaaatcagtatttagtacctggttataacaggtggtgggcatgcaatactgggttaaccccctgtgtttccacctcagtcttcaaccaatccaaagatttctgtgtcatggtccaaatcatcccccgagtgtactaccatcctgaggaagtggtccttgatgaatatgactatcggtataaccgaccaaaaagagaacccgtatcccttaccctagctgtaatgctcggattagggacggccgttggcgtaggaacagggacagctgccctgatcacaggaccacagcagctagagaaaggacttggtgagctacatgcggccatgacagaagatctccgagccttagaggagtctgttagcaacctagaagagtccctgacttctttgtctgaagtggttctacagaaccggaggggattagatctgctgtttctaagagaaggtgggttatgtgcagccttaaaagaagaatgttgcttctatgtagatcactcaggagccatcagagactccatgagcaagcttagagaaaggttagagaggcgtcgaagggaaagagaggctgaccaggggtggtttgaaggatggttcaacaggtctccttggatgaccaccctgctttctgctctgacgggacccctagtagtcctgctcctgttacttacagttgggccttgcttaattaataggtttgttgcctttgttagagaacgagtgagtgcagtccagatcatggtacttaggcaacagtaccaaggccttctgagccaaggagaaactgacctctagccttcccagttctaagattagaactattaacaagacaagaagtggggaatgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgacagccctagtgacctatctcaactgcaatctgtcactctgcccaggagcccacgcagatgcggacctccggagctattttaaaatgattggtccacggagcgcgggctctcgatattttaaaatgattggtccacggagcgcgggctctcgatattttaaaatgattggtccacggagcgcgggctctcgatattttaaaatgattggtttgtgacgcacaggctttgttgtgaaccccataaaagctgtcccgattccgcactcggggccgcagtcctctacccctgcgtggtgtacgactgtgggccccagcgcgcttggaataaaaaatcctcttgctgtttgcatcaagaccgcttctcgtgagtgatttggggtgtcgcctcttccgagcccgg

SEQ ID NO: 259 - DNA, 8985 bp, artificial
  338173790_B sequence
aagtaggcaggtagagataagaaagtaagaacaagcaagcactgtgtgcattgtttagaagtagagcttggtctaatcaggcacatgtggttaagctttgaggatacctgttacccatgtaactctcagagattttcagtgctcctgccaaactcagttcttgagagagtggtgttgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagataacaggaaatgagttgactaattgcttatctggattctgtaaaactgactggcaccatagaagaattgattacacattgacagccctagtgacctatctcaactgcaatctgtcactctgcccaggagcccacgcagatgcggacctccggagctattttaaaatgattggtccacggagcgcgggctctcgatattttaaaatgattggtccacggagcgcgggctctcgatattttaaaatgattggtttgtgacgcacaggctttgttgtgaaccccataaaagctgtcccgattccgcactcggggccgcagtcctctacccctgcgtggtgtatgactgtgggccccagcgcgcttggaataaaaatcctcttgctgtttgcatcaagaccgcttctcgtgagtgatttggggtgtcgcctcttccgagcccggacgagggggattgttcttttactggcctttcatttggtgcgttggccgggaagtcctgcgaccaccccttacacccgagaaccgacttggaggtaaagggatcccctttggaacgtgtgtgtgtcggccggcgtctctgttctgagtgtctgttttcggtgatgcgcgctttcggtttgcagctgtcctctcagaccgtaaggactggaggactgtgatcagcagacgtgctaggaggatcacaggctgccgccctgggggacgccctgggaggtggggagagccagggacgcctggtggtctcctactgtcggtcagaggaccgagttctgttgttgaagcgaaagcttccccctccgcggccgtccgactcttttgcctgcttgtggaagacgcggacgggtcgcgtgtgtctggatctgttggtttctgtttcgtgtgtctttgtcttgtgcgtccttgtctacagttttaatatgggacagacagtgacgaccccccttagtttgactctcgaccattggactgaagttagatccagggctcataatttgtcagttcaggttaagaagggaccttggcagactttctgtgcctctgaatggccaacattcgatgttggatggccatcagaggggacctttaattctgaaattatcctggctgttaaagcagtcatttttcagactggacccggctctcatcctgatcaggagccctatatccttacgtggcaagatttggcagaagatcctccgccatgggttaaaccatggctaaataaaccaagaaagccaggtccccgaatcctggctcttggagagaaaaacaaacactcggccgaaaaagtcgagccctctcctcgtatctaccccgagatcgaggagccgccgacttggccggaaccccaacctgttcccccacccccttatccagaacagggtgctgtgaggggaccctctgcccctcctggagctccggtggtggagggacctgctgccgggactcggagccggagaggcgccaccccggagcggacagacgagatcgcgacattaccgctgcgcacctatggccctcccatgccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaatttggctaaggtaagagaggtgatgcagggaccgaacaaacctccctcggtatttcttgagaggctcatggaagccttcaggcggttcaccccttttgatcctacctcggaggcccagaaagcctcagtggccctggccttcattgggcagtcggctctggatatcagaaagaaacttcagagactggaagggttacaggaggctgagttacgtgatctagtgagagaggcagagaaggtgtattacagaagggagacagaagaggagaaggaacagagaaaagaaaaggagagagaagaaagggaggaaagacgtgatagacggcaagagaagaatttgactaagatcttggccgcagtggttgaagggaagagcagcagggagagagagagagattttaggaaaattaggtcaggccctagacagtcagggaacctgggcaataggaccccactcgacaaggaccagtgtgcgtattgtaaagaaaaaggacactgggcaaggaactgccccaagaagggaaacaaaggaccgaaggtcctagctctagaagaagataaagattaggggagacggggttcggaccccctccccgagcccagggtaactttgaaggtggaggggcaaccagttgagttcctggttgataccggagcggagcattcagtgctgctacaaccattaggaaaactaaaagaaaaaaaatcctgggtgatgggtgccacagggcaacggcagtatccatggactacccgaagaaccgttgacttgggagtgggacgggtaacccactcgtttctggtcatccctgagtgcccagtaccccttctaggtagagacttactgaccaagatgggagctcaaatttcttttgaacaaggaagaccagaagtgtctgtgaataacaaacccatcactgtgttgaccctccaattagatgatgaatatcgactatattctccccaagtaaagcctgatcaagatatacagtcctggttggagcagtttccccaagcctgggcagaaaccgcagggatgggtttggcaaagcaagttcccccacaggttattcagctgaaggccagtgctacaccagtatcagtcagacagtaccccttgagtagagaggctcgagaaggaatttggccgcatgttcaaagattaatccaacagggcatcctagttcctgtccaatccccttggaatactcccctgctaccggttaggaagcctgggaccaatgattatcgaccagtacaggacttgagagaggtcaataaaagggtgcaggacatacacccaacggtcccgaacccttataacctcttgagcgccctcccgcctgaacggaactggtacacagtattggacttaaaagatgccttcttctgcctgagattacaccccactagccaaccactttttgccttcgaatggagagatccaggtacgggaagaaccgggcagctcacctggacccgactgccccaagggttcaagaactccccgaccatctttgacgaagccctacacagggacctggccaacttcaggatccgacaccctcaggtgaccctcctccagtacgtggatgacctgcttctggcgggagccaccaaacaggactgcttagaaggtacgaaggcactactgctggaattgtctgacctaggctacagagcctctgctaagaaggcccagatttgcaggagagaggtaacatacttggggtacagtttgcggggcgggcagcgatggctgacggaggcacggaagaaaactgtagtccagataccggccccaaccacagccaaacaagtgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccgaggagttttaacccaaaccctaggaccatggaggagacctgttgcctacctgtcaaagaagcttgatcctgtagccagtggttggcccgtatgcctgaaggctatcgcagctgtggccatactggtcaaggacgctgacaaattgactttgggacagaatataactgtaatagccccccatgcgttggagaacatcgttcggcagcccccagactgatggatgaccaacgcccgcatgacccactatcaaagcctgcttctcacagagagggtcacgttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaggatggctggggcggcggtggtggacgggacccgcacgatctgggccagcagcctgccggaaggaacttcagcgcaaaaggctgagctcatggccctcacgcaagctttgcggctggccgaagggaaatccataaacatttatacggatagcaggtatgcctttgcgactgcacacgtacacggggccatctataaacaaagggggttgcttacctcagcagggagggaaataaagaacaaagaggaaattctaagcctattagaagccttacatttgccaaaaaggctagctattatacactgtcctggacatcagaaagccaaagatctcatatctagagggaaccagatggctgaccgggttgccaagcaggcagcccaggctgttaaccttctgcctataatagaaacgcccaaagccccagaacccagacgacagtacaccctagaagactggcaagagataaaaaagatagaccagttctctgagactccggaggggacctgctatgcctcatatgggaaggaaatcctgccccacaaagaagggttagaatatgtccaacagatacatcgtctcacccacctaggaactaaacacctgtagcagttggtcagaacatccccttatcatgttctgaggctaccaggagtggctgactcggtggtcaaacattgtgtgccctgccagctggttaatgctaatccttccaaagtacctccagggaagagactaagggggagccacccaggcgctcactgggaagtggacttcactgaagtaaagccggctaaatacggaaacaaatacctattggtttttgtagacacattttcaggatgggtagaggcttatcctactaagaaagagacttcaaccgtggtggctaaaaaaatactggaggaaatttttccgagatttggaatacctaaggtaatcgggtcagacaatggtccagcttttgttgcccaggtaagtcagggactggccaagatattggggattgattggaaactgcattgtgcatacagaccccaaagctcaggacaggtagagaggatgaatagaaccattaaagagaccctcaccaaattgaccacagagactggcattaatgattggatagctctcctgccctttgtgctttttagggttaggaacacccctggacagtttgggctgaccccctatgaattgctctacgggggaccccccccccgttggtagaaattgcttctgtacatagtgctgatgtgctgctttcccagcctttgttctctaggctcaaggcgctcgagtgggtgaggcagcgagcgtggaagcagctccgggaggcctactcaggagaaggagacttgcaagttccacatcgcttccaagtgggagattcagtctatgttagacgccaccgtgcaggaaacctcgagactcggtggaagggcccttatctcgtacttttgaccacaccaacggctgtgaaagtcgaaggaatctccacctggatccatgcatcccacgttaagctggcgccacctcccgactcggggtggagagccgaaaagactgagaatccccttaagcttcgcctccatcgcctggttccttactctaacaataactccccaggccagtagtaaacgccttatagacagctcgaacccccatagacctttatcccttacctggctgattattgaccctgatacgggtgtcactgtaaatagcactcgaggtgttgctcctagaggcacctggtggcctgaactgcatttctgcctccgattgattaaccccgctgttaaaagcacacctcccaacctagtccgtagttatgggttctattgctgcccaggcacagagaaagagaaatactgtgggggttctggggaatccttctgtaggagatggagctgcgtcacctccaacgatggagactggaaatggccgatctctctccaggaccgggtaaaattctcctttgtaaattccggcccgggcaagtacaaagtgatgaaactatataaagataagagctgctccccatcagacttagattatctaaagataagtttcactgaaaaaggaaaacaggaaaatattcaaaagtggataaatggtatgagctggggaatagttttttataaatatggcgggggagcagggtccactttaaccattcgccttaggatagagacggggacagaaccccctgtggcagtgggacccgataaagtactggctgaacaggggcccccggccctggagccaccgcataacttgccggtgccccaattaacctcgctgcggcctgacataacacagccgcctagcaacggtaccactggattgattcctaccaacacgcctagaaactccccaggtgttcctgttaagacaggacagagactcttcagtctcatccagggagctttccaagccatcaactccaccgaccccgatgccacttcttcttgttggctttgtctatcctcagggcctccttattatgaggggatggctaaagaaggaaaattcaatgtgaccaaagagcatagaaatcaatgtacatgggggtcccgaaataagcttaccctcactgaagtttccgggaaggggacatgcataggaaaagctcccccatcccaccaacacctttgctatagtactgtggtttatgagcaggcctcagaaaatcagtatttagtacctggttataacaggtggtgggcatgcaatactgggttaaccccctgtgtttccacctcagtcttcaaccaatccaaagatttctgtgtcatggtccaaatcgtcccccgagtgtactaccaccctgaggaagtggtccttgatgaatatgactatcggtataaccgaccgaaaagagaacccgtatcccttaccctagctgtaatgctcggattagggacggccgttggcgtaggaacagggacagctgccctgatcacaggaccacagcagctagagaaaggacttggtgagctacatgcggccatgacagaagatctccgagccttagaggagtctgttagcaacctagaagagtccctgacttctttgtctgaagtggttctacagaaccggaggggattagatctgctgtttctaagagaaggtgggttatgtgcagccttaaaagaagaatgttgcttctatgtagatcactcaggagccatcagagactccatgagcaagcttagagaaaggttagagaggcgtcgaagggaaagagaggctgaccaggggtggtttgaaggatggttcaacaggtctccttggatgaccaccctgctttctgctctgacgggacccctagtagtcctgctcctgttacttacagttgggccttgcttaattaataggtttgttgcctttgttagagaacgagtgagtgcagtccagatcatggtacttaggcaacagtaccaaggccttctgagccaaggagaaactgacctctagccttcccagttctaagattagaactattaacaagacaagaagtggggaatgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaattgcttatctggattctgtaaaactgactggcaccatagaagaattgattacacattgacagccctagtgacctatctcaactgcaatctgtcactctgcccaggagcccacgcagatgcggacctccggagctattttaaaatgattggtccacggagcgcgggctctcgatattttaaaatgattggtccacggagcgcgggctctcgatattttaaaatgattggtttgtgacgcacaggctttgttgtgaaccccataaaagctgtcccgattccgcactcggggccgcagtcctctacccctgcgtggtgtatgactgtgggccccagcgcgcttggaataaaaatcctcttgctgtttgcatcaagaccgcttctcgtgagtgatttggggtgtcgcctcttccgagcccggacgagggggattgttcttttactggcctttcagtgtattaacatttcatggacccagtttatacctacccattttctatcgatc

SEQ ID NO: 260 - DNA, 9104 bp, artificial
  338173787_sequence
  misc_feature (39)..(39): n is a, c, g, or t
ttaccaaaagcagatgcatgggggaggactggttggggncagttggctagactttgcttagtcatcatggctggggtctctcctttctacattttattgggacattttctcctacaccagctgatttgatctttgatcccttgcatagttgaaggggtgtcttttataaaagcactaatcccattcataaggctccacctgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaactgattacacattgacagccctagtgacctatctcaactgcaatctgtcactctgcccaggagcccacgcagatgcggacctccggagctattttaaaatgattggtccacggagcgcgggctctcgatattttaaaatgattggtccacggagcgcgggctctcgatattttaaaatgattggtttgtgacgcacaggctttgttgtgaaccccataaaagctgtcccgattccgcactcggggccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgagggggattgttcttttactggcctttcatttggtgcgttgaccgggaaaccctgcgaccaccccttacacccgagaaccgacttggaggtaaagggatcccctttggaacgtgtgtgtgtcggccggcgtctctgttctgagtgtctgttttcggtgatgcgcgctttcggtttgcagctgtcctctcagaccgtaaggactggaggactgtgatcagcagacgtgctaggaggatcacaggctgccaccctgggggacgccccgggaggtggggagagccagggacgcctggtggtctcctactgtcggtcagaggaccgagttctgttgttgaagcgaaagcttccccctccgcggccgtccgactcttttgcctgcttgtggaagacgcggacgggtcgcgtgtgtctggatctgttggtttctgtttcgtgtgtctttgtcttgtgcgtccttgtctacagttttaatatgggacagacagtgacgaccccccttagtttgactctcgaccattggactgaagttagatccagggctcataatttgtcagttcaggttaagaagggaccttggcagactttctgtgcctctgaatggccaacattcgatgttggatggccatcagaggggacctttaattctgaaattatcctggctgttaaggcaatcatttttcagactggacccagctctcatcctgatcaggagccctatatccttacgtggcaagatttggcagaagatcctccgccatgggttaaaccatggctaaataaaccaagaaagccaggtccccgaatcctggctcttggagagaaaaacaaacactcggccgaaaaagtcgagccctctcctcgtatctaccccgagatcgaggagccgccgacttggccggaaccccaacctgttcccccacccccttatccagcacagggtgctgtgaggggaccctctgcccctcctggagctccggtggtggagggacctgctgccgggactcggagccggagaggcgccaccccggagcggacagacgagatcgcgatattaccgctgcgcacctatggccctcccatgccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaatttggctaaggtaagagaggtgatgcagggaccgaacgaacctccctcggtatttcttgagaggctcatggaagccttcaggcggttcaccccttttgatcctacctcggaggcccagaaagcctcagtggccctggccttcattgggcagtcggctctggatatcagaaagaaacttcagagactggaagggttacaggaggctgagttacgtgatctagtgagagaggcagagaaggtgtattacagaagggagacagaagaggagaaggaacagagaaaagaaaaggagagagaagaaagggaggaaagacgtgatagacggcaagagaagaatttgactaagatcttggccgcagtggttgaagggaagagcagcagggagagagagagagattttaggaaaattaggtcaggccctagacagtcagggaacctgggcaataggaccccactcgacaaggaccagtgtgcgtattgtaaagaaaaaggacactgggcaaggaactgccccaagaagggaaacaaaggaccgaaggtcctagctctagaagaagataaagattaggggagacggggttcggaccccctccccgagcccagggtaactttgaaggtggaggggcaaccagttgagttcctggttgataccggagcggagcattcagtgctgctacaaccattaggaaaactaaaagaaaaaaaatcctgggtgatgggtgccacagggcaacggcagtatccatggactacccgaagaaccgttgacttggcagtgggatgggtaacccactcgtttctggtcatccctgagtgcccagtaccccttctaggtagagacttactgaccaagatgagagctcaaatttcttttgaacaaggaagaccagaagtgtctgtgaataacaaacccatcactgtgttgaccctccaattagatgatgaatatcgactatattctccccaagtaaagcctgatcaagatatacagtcctggttggagcagtttccccaagcctgggcagaaaccacagggatgggtttggcaaagcaagttcccccacaggttattcaactgaaggccagtgctacaccagtatcagtcagacagtaccccttgagtagagaggctcgagaaggaatttggccgcatgttcaaagattaatccaacagggcatcctagttcctgtccaatccccttggaatactcccctgctaccggttaggaagcctgggaccaatgattatcgaccagtacaggacttgagagaggtcaataaaagggtgcaggacatacacccaacggtcccgaacccttataacctcttgagcgccctcccgcctgaacggaactggtacacagtattggacttaaaagatgccttcttctgcctgagattacaccccactagccaaccgctttttgccttcgaatggagagatccaggtacgggaagaaccgggcagctcacctggacccgactgccccaagggttcaagaactccccgaccatctttgacgaagccctacacagggacctggccaacttcaggatccaacaccctcaggtgaccctcctccagtacgtggatgacctgcttctggcgggagccaccaaacaggactgcttagaaggtacgaaggcactactgctgaaattgtctgacctaggctacagagcctctgctaagaaggcccagatttgcaggagagaggtaacatacttggggtacagtttgcggggcgggcagcgatggctgacggaggcacggaagaaaactgtagtccagataccggccccaaccacagccaaacaagtgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccgaggagttttaacccaaaccctaggaccatggaggagacctgttgcctacctgtcaaagaagcttgatcctgtagccagtggttggcccgtatgcctgaaggctatcgcagctgtggccatactggtcaaggacgctgacaaattgactttgggacagaatataactgtaatagccccccatgcattggagaacatcgttcggcagcccccagaccgatggatgaccaatgcccgcatgacccactatcaaagcctgcttctcacagagagggtcactttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaggatggctgggacggcggtggtggacgggacccacacgatctgggccagcagcctgccggaaggaacttcagcgcaaaaggctgagctcatggccctcacgcaagctttgcggctggccgaagggaaatccataaacatttatacggacagcaggtatgcctttgcgactgcacacgtacacggggccatctataaacaaagggggttgcttacctcagcagggagggaaataaagaacaaagaggaaattctaagcctattagaagccttacatttgccaaaaaggctagctattatacactgtcctggacatcagaaagccaaagatctcatatctagagggaaccagatggctgaccgggttgccaagcaggcagcccaggctgttaaccttctgcctataatagaaacgcccaaagccccagaacccagacgacagtacaccctagaagactggcaagagataaaaaagatagaccagttctctgagactccggaggggacctgctatacctcatatgagaaggaaatcctgccccacaaagaagggttagaatatgtccaacagatacatcgtctcacccacctaggaactaaacacctgcagcagttggtcagaacatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaaaaaaatactggaggaaatttttccgagatttggaatacctaaggtaatcgggtcagacaatggtccagcttttgttgcccaggtaagtcagggactggccaagatattggggattgattgaaaactgcattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccctatgaattgctctacgggggaccccccccgttggtagaaattgcttctgtacatagtgctgatgtgctgctttcccagcctttgttctctaggctcaaggcgctcgagtgggtgaggcaacgagcgtggaagcagctccgggaggcctactcaggagaaggagacttgcaagttccacatcgcttccaagtgggagattcagtctatgttagacgccaccgtgcaggaaacctcgagactcggtggaagggcccttatctcgtacttttgaccacaccaacggctgtgaaagtcgaaggaatctccacctggatccatgcatcccacgttaagctggcgccacctcccgactcggggtggagagccgaaaagactgagaatccccttaagcttcgcctccatcgcctggttccttactctaacaataactccccaggccagtagtaaacgccttatagacagctcgaacccccatagacctttatcccttacctggctgattattgaccctgatacgggtgtcactgtaaatagcactcgaggtgttgctcctagaggcacctggtggcctgaactgcatttctgcctccgattgattaaccccgctgttaaaagcacacctcccaacctagtccgtagttatgggttctattgctgcccaggcacagagaaagagaaatactgtgggggttctggggaatccttctgtaggagatggagctgtgtcacctccaacgatggagactggaaatggccgatctctctccaggaccgggtaaaattctcctttgtcaattccggcccgggcaagtacaaagtgatgaaactatataaagataagagctgctccccatcagacttagattatctaaagataagtttcactgaaaaaagaaaacaggaaaatattcaaaagtggataaatggtatgagctggggaatagttttttataaatatggcgggggagcagggtccactttaaccattcgccttaggatagagacggggacagaaccccctgtggcagtgggacccgataaagtactggctgaacaggggcccccggccctggagccaccgcataacttgccggtgccccaattaacctcgctgcggcctgacataacacagccgcctagcaacggtaccactggattgattcctaccaacacgcctagaaactccccaggtgttcctgttaagacaggacagagactcttcagtctcatccagggagctttccaagccatcaactccaccgaccctgatgccacttcttcttgttggctttgtctatcctcagggcctccttattatgaggggatggctaaagaaggaaaattcaatgtgaccaaagagcatagaaatcaatgtacatgggggtcccaaaataagcttaccctcactgaagtttccgggaaggggacatgcataggaaaagctcccccatcccaccaacacctttgctatagtactgtggtttatgagcaggcctcagaaaatcagtatttagtacctggttataacaggtggtgggcatgcaatactgggttaaccccctgtgtttccacctcagtcttcaaccaatccaaaaatttctgtgtcatggtccaaatcgtcccccgagtgtactaccatcctgagaaagtggtccttgatgaatatgactatcggtataaccgaccaaaaagagaacccgtatcccttaccctagctgtaatgctcggattagggacggccgttggcgtaggaacagggacagctgccctgatcacaggaccacagcagctagagaaaggacttggtgaactacatgcggccatgacagaagatctccgagccttagaggagtctgttagcaacctagaagagtccctgacttctttgtctgaagtggttctacagaaccggaggggattagatctgctgtttctaagagaaggtgggttatgtgcagccttaaaagaagaatgttgcttctatgtagatcactcaggagccatcagagactccatgagcaagcttagagaaaggttagagaggcgtcgaagggaaagagaggctgaccaggggtggtttgaaggatggttcaacaggtctccttggatgaccaccctgctttctgctctgacgggacccctagtagtcctgctcctgttacttacagttgggccttgcttaattaataggtttgttgcctttgttagagaacgagtgagtgcagtccagatcatggtacttaggcaacagtaccaaggccttctgagccaaggagaaactgacctctagccttcccagttctaagattagaactattaacaagacaagaagtggggaatgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgacagccctagtgacctatctcaactgcaatctgtcactctgcccaggagcccacgcagatgcggacctccggagctattttaaaatgattggtccacggagcgcgggctctcgatattttaaaatgattggtccacggagcgcgggctctcgatattttaaaatgattggtttgtgacgcacaggctttgttgtgaaccccataaaagctgtcccgattccgcactcggggccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgagggggattgttcttttactggcctttcacaccctcatggccagatcatgtcccaaggtccttgtctccaacaccatcactttgggggttaggatttccacatatgaatttgacaggatgcagacatcagtttatgcagcagctatcttataactttgagatgtctctgccttt

SEQ ID NO: 261 - DNA, 9058 bp, artificial
  338173783_B sequence
  misc_feature (827)..(827): n is a, c, g, or t
  misc_feature (838)..(838): n is a, c, g, or t
  misc_feature (845)..(845): n is a, c, g, or t
  misc_feature (847)..(849): n is a, c, g, or t
tatccccacaacccagcacatccccaccccccgaactttctcctttggaaaccgttagtttttcaaagtctgtgagtcaatatctgctccacaaagaagatcattctgtccttttttcagattccacatgtcagtgaaagcatttgatgttggtgttgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgacagccctagtgacctatctcaactgcaatctgtcactctgcccaggagcccacgcagatgcggacctccggagctattttaaaatgattggtccacggagcgcgggctctcgatattttaaaatgattggtttgtgacgcacaggctttgttgtgaaccccataaaagctgtcccgattccgcactcggggccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgagggggattgttcttttactggcctttcatttggtgcgttggccgggaaatcctgcgaccaccccttacacccgagaaccgacttggaggtaaagggatccccttggaancgtgtgtgtgntcggccngnnnttgtgtgtgtgtgtcggccggcgtctctgttcggagtgtctgttttcggagatgcgcgctttcggtttgcagctgtcctctcagaccgtaaggactggaggactgtgatcagcagacgtgctaggaggatcacaggctgccaccctgggggacaccccgggaggtggggagagccagggacgcctggtggtctcctactgtcggtcagaggaccgagttctgttgttgaagcgaaagcttccccctccgcggccgtccgactcttttgcctgcttgtggaagacgcggccgggtcgcgtgtgtctggatctgttggtttctgtttcgtgtgtctttgtcttgtgcgtccttgtctacagttttaatatgggacagacagtgacgaccccccttagtttgactctcgaccattggactgaagttagatccagggctcataatttgtcagttcaggttaagaagggaccttggcagactttctgtgcctctgaatggccaacattcgatgttggatggccatcagaggggacctttaattctgaaattatcctggctgttaaggcaatcatttttcagactggacccagctctcatcctgatcaggagccctatatccttacgtggcaagatttggcagaagatcctccgccatgggttaaaccatggctaaataaaccaagaaagccaggtccccgaatcctggctcttggagagaaaaacaaacactcggccgaaaaagtcgagccctctcctcgtatctaccccgagatcgaggagccgccgacttggccggaaccccaacctgttcccccacccccttatccagcacagggtgctgtgaggggaccctctgcccctcctggagctccggtggtggagggacctgctgccgggactcggagccggagaggcgccaccccggagcggacagacgagatcgcgatattaccgctgcgcacctatggccctcccatgccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcaagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaatttggctaaggtaagagaggtgatgcagggaccgaacgaacctccctcggtatttcttgagaggctcatggaagccttcaggcggttcaccccttttgatcctacctcggaggcccagaaagcctcagtggccctggccttcattgggcagtcggctctggatatcagaaagaaacttcagagactggaagggttacaggaggctgagttacgtgatctagtgagagaggcagagaaggtgtattacagaagggagacagaagaggagaaggaacagagaaaagaaaaggagagagaagaaagggaggaaagacgtgatagacggcaagagaagaatttgactaagatcttggccgcagtggttgaagggaagagcagcagggagagagagagagattttaggaaaattaggtcaggccctagacagtcagggaacctgggcaataggaccccactcgacaaggaccagtgtgcgtattgtaaagaaaaaggacactgggcaaggaactgccccaagaagggaaacaaaggaccgaaggtcctagctctagaagaagataaagattaggggagacggggttcggaccccctccccgagcccagggtaactttgaaggtggaggggcaaccagttgagttcctggttgataccggagcggagcattcagtgctgctacaaccattaggaaaactaaaagaaaaaaaatcctgggtgatgggtgccacagggcaacggcagtatccatggactacccgaagaaccgttgacttgggagtgggacgggtaacccactcgtttctggtcatccctgagtgcccagtaccccttctaggtagagacttactgaccaagatgggagctcaaatttcttttgaacaaggaagaccagaagtgtctgtgaataacaaacccatcactgtgttgaccctccaattagatgatgaatatcgactatattctccccaagtaaagcctgatcaagatatacagtcctggttggagcagtttccccaagcctgggcagaaaccgcagggatgggtttggcaaagcaagttcccccacaggttattcaactgaaggccagtgctacaccagtatcagtcagacagtaccccttgagtagagaggctcgagaaggaatttggccgcatgttcaaagattaatccaacagggcatcctagttcctgtccaatccccttggaatactcccctgctaccggttaggaagcctgggaccaatgattatcgaccagtacaggacttgagagaggtcaataaaagggtgcaggacatacacccaacggtcccgaacccttataacctcttgagcgccctcccgcctgaacggaactggtacacagtattggacttaaaagatgccttcttctgcctgagattacaccccactagccaaccgctttttgccttcgaatggagagatccaggtacgggaagaaccgggcagctcacctggacccgactgccccaagggttcaagaactccccgaccatctttgacgaagccctacacagggacctggccaacttcaggatccaacaccctcaggtgaccctcctccagtacgtggatgacctgcttctggcgggagccaccaaacaggactgcttagaaggtacgaaggcactactgctggaattgtctgacctaggctacagagcctctgctaagaaggcccagatttgcaggagagaggtaacatacttggggtacagtttgcggggcgggcagcgatggctgacggaggcacggaagaaaactgtagtccagataccggccccaaccacagccaaacaagtgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccgaggagttttaacccaaaccctaggaccatggaggagacctgttgcctacctgtcaaagaagcttgatcctgtagccagtggttggcccgtatgcctgaaggctatcgcagctgtggccatactggtcaaggacgctgacaaattgactttgggacagaatataactgtaatagccccccatgcattggagaacatcgttcggcagcccccagaccgatggatgaccaacgcccgcatgacccactatcaaagcctgcttctcacagagagggtcactttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaggatggctggggcggcggtggtggacgggacccacacgatctgggccagcagcctgccggaaggaacttcagcgcaaaaggctgagctcatggccctcacgcaagctttgcggctggccgaagggaaatccataaacatttatacggacagcaggtatgcctttgcgactgcacacgtacacggggccatctataaacaaagggggttgcttacctcagcagggagggaaataaagaacaaagaggaaattctaagcctattagaagccttacatttgccaaaaaggctagctattatacactgtcctggacatcagaaagccaaagatctcatatctagagggaaccagatggctgaccgggttgccaagcaggcagcccaggctgttaaccttctgcctataatagaaacgcccaaagccccagaacccagacgacagtacaccctagaagactggcaagagataaaaaagatagaccagttctctgagactccggaggggacctgctatacctcatatgggaaggaaatcctgccccacaaagaagggttagaatatgtccaacagatacatcgtctcacccacctaggaactaaacacctgcagcagttggtcagaacatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaaaaaaatactggaggaaatttttccgagatttggaatacctaaggtaatcgggtcagacaatggtccagcttttgttgcccaggtaagtcagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccctatgaattgctctacgggggaccccccccgttggtagaaattgcttctgtacatagtgctgatgtgctgctttcccagcctttgttctctaggctcaaggcgctcgagtgggtgaggcaacgagcgtggaagcagctccgggaggcctactcaggagaaggagacttgcaagttccacatcgcttccaagtgggagattcagtctatgttagacgccaccgtgcaggaaacctcgagactcggtggaagggcccttatctcgtacttttgaccacaccaacggctgtgaaagtcgaaggaatctccacctggatccatgcatcccacgttaagctggcgccacctcccgactcggggtggagagccgaaaagactgagaatccccttaagcttcgcctccatcgcctggttccttactctaacaataactccccaggccagtagtaaacgccttatagacagctcgaacccccatagacctttatcccttacctggctgattattgaccctgatacgggtgtcactgtaaatagcactcgaggtgttgctcctagaggcacctggtggcctgaactgcatttctgcctccgattgattaaccccgctgttaaaagcacacctcccaacctagtccgtagttatgggttctattgctgcccaggcacagagaaagagaaatactgtgggggttctggggaatccttctgtaggagatggagctgcgtcacctccaacgatggagactggaaatggccgatctctctccaggaccgggtaaaattctcctttgtcaattccggcccgggcaagtacaaagtgatgaaactatataaagataagagctgctccccatcagacttagattatctaaagataagtttcactgaaaaaggaaaacaggaaaatattcaaaagtggataaatggtatgagctggggaatagttttttataaatatggcgggggagcagggtccactttaaccattcgccttaggatagagacggggacagaaccccctgtggcagtgggacccgataaagtactggctgaacaggggcccccggccctggagccaccgcataacttgccggtgccccaattaacctcgctgcggcctgacataacacagccgcctagcaacggtaccactggattgattcctaccaacacgcctagaaactccccaggtgttcctgttaagacaggacagagactcttcagtctcatccagggagctttccaagccatcaactccaccgaccccgatgccacttcttcttgttggctttgtctatcctcagggcctccttattatgaggggatggctaaagaaggaaaattcaatgtgaccaaagagcatagaaatcaatgtacatgggggtcccgaaagaagcttaccctcactgaagtttccgggaaggggacatgcataggaaaagctcccccatcccaccaacacctttgctatagtactgtggtttatgagcaggcctcagaaaatcagtatttagtacctggttataacaggtggtgggcatgcaatactgggttaaccccctgtgtttccacctcagtcttcaaccaatccaaagatttctgtgtcatggtccaaatcgtcccccgagtgtactaccatcctgaggaagtggtccttgatgaatatgactatcggtataaccgaccaaaaagagaacccatatcccttaccctagctgtaatgctcggattagggacggccgttggcgtaggaacagggacagctgccctgatcacaggaccacagcagctagagaaaggacttggtgagctacatgcggccatgacagaagatctccgagccttagaggagtctgttagcaacctagaagagtccctgacttctttgtctgaagtggttctacagaaccggaggggattagatctgctgtttctaagagaaggtgggttatgtgcagccttaaaagaagaatgttgcttctatgtagatcactcaggagccatcagagactccatgagcaagcttagagaaaggttagagaggcgtcgaagggaaagagaggctgaccaggggtggtttgaaggatggttcaacaggtctccttggatgaccaccctgctttctgctctgacgggacccctagtagtcctgctcctgttacttacagttgggccttgcttaattaataggtttgttgcctttgttagagaacgagtgagtgcagtccagatcatggtacttaggcaacagtaccaaggccttctgagccaaggagaaactgacctctagccttcccagttctaagattagaactattaacaagacaagaagtggggaatgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgacagccctagtgacctatctcaactgcaatctgtcactctgcccaggagcccacgcagatgcggacctccggagctattttaaaatgattggtccacggagcgcgggctctcgatattttaaaatgattggtccacggagcgcgggctctcgatattttaaaatgattggtccacggagcgcgggctctcgatattttaaaatgattggtccacggagcgcgggctctcgatattttaaaatgattggtttgtgacgcacaggctttgttgtgaaccccataaaagctgtcccgattccgcactcggggccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgagggggattgttcttttactggcctttcaggttctcattggccatgatgagtttttaactccttcctgatttcatgcattaccttttgtttcttccccttttttttt

SEQ ID NO: 262 - DNA, 9136 bp, artificial
  338173781_B sequence
gtcctctctctttaaggcattttgaatataaactccctatcaggcatatgtctgaaaaatatattttcagtttgtcaatatttttctttgctgtgcaaaaacttttaaactttaactagatcacatttgtttattttgcttttatttcccttacctgaggtgacagatccaagcaaatattgctaagatttttgtcaaagagtgtactgcctatgttcttctaggaattttatggttttgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgacagccctagtgacctatctcaactgcaatctgtcactctgcccaggagcccacgcagatgcggacctccggagctattttaaaatgattggtccacggagcgcgggctctcgatattttaaaatgattggtccacggagcgcgggctctcgatattttaaaatgattggtttgtgacgcacaggctttgttgtgaaccccataaaagctgtcccgattccgcactcggggccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgagggggattgttcttttactggcctttcatttggtgcgttggccgggaaatcctgcgaccaccccttacacccgagaaccgacttggaggtaaagggatcccctttggaacgtgtgtgtgtgtcggccggcgtctctgttctgagtgtctgttttcggtgatgcgcgctttcggtttgcagctgtcctctcagaccgtaaggactggaggactgtgatcagcagacgtgctaggaggatcacaggctgccaccctgggggacgccccgggaggtggggagagccagggacgcctggtggtctcctactgtcggtcagaggaccgagttctgttgttgaagcgaaagcttccccctccgcggccgtccgactcttttgcctgcttgtggaagacgcggacgggtcgcgtgtgtctggatctgttggtttctgtttcgtgtgtctttgtcttgtgcgtccttgtctacagttttaatatgggacagacagtgacgaccccccttagtttgactctcgaccattggactgaagttagatccagggctcataatttgtcagttcaggttaagaagggaccttggcagactttctgtgcctctgaatggccaacattcgatgttggatggccatcagaggggacctttaattctgaaattatcctggctgttaaggcaatcatttttcagactggacccggctctcatcctgatcaggagccctatatccttacgtggcaagatttggcagaagatcctccgccatgggttaaaccatggctaaataaaccaagaaagccaggtccccgaatcctggctcttggagagaaaaacaaacactcggccgaaaaagtcgagccctctcctcgtatctaccccgagatcgaggagccgccgacttggccggaaccccaacctgttcccccacccccttatccagcacagggtgctgtgaggggaccctctgcccctcctggagctccggtggtggagggacctgctgccgggactcggagccggagaggcgccaccccggagcggacagacgagatcgcgatattaccgctgcgtacctatggccctcccatgccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagtgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaatttggctaaggtaagagaggtgatgcagggaccgaacgaacctccctcggtatttcttgagaggctcatggaagccttcaggcggttcaccccttttgatcctacctcggaggcccagaaagcctcagtggccctggccttcattgggcagtcggctctggatatcagaaagaaacttcagagactggaagggttacaggaggctgagttacgtgatctagtgagagaggcagagaaggtgtattacagaagggagacagaagaggagaaggaacagagaaaagaaaaggagagagaagaaagggaggaaagacgtgatagacggcaagagaagaatttgactaagatcttggccgcagtggttgaagggaagagcagcagggagagagagagagattttaggaaaattaggtcaggccctagacagtcagggaacctgggcaataggaccccactcgacaaggaccagtgtgcgtattgtaaagaaaaaggacactgggcaaggaactgccccaagaagggaaacaaaggaccgaaggtcctagctctagaagaagataaagattaggggagacggggttcggaccccctccccgagcccagggtaactttgaaggtggaggggcaaccagttgagttcctggttgataccggagcggagcattcagtgctgctacaaccattaggaaaactaaaagaaaaaaaatcctgggtgatgggtgccacagggcaacggcagtatccatggactacccgaagaaccgttgacttgggagtgggacgggtaacccactcgtttctggtcatccctgagtgcccagtaccccttctaggtagagacttactgaccaagatgggagctcaaatttcttttgaacaaggaagaccagaagtgtctgtgaataacaaacccatcactgtgttgaccctccaattagatgatgaatatcgactatattctccccaagtaaagcctgatcaagatatacagtcctggttggagcagtttccccaagcctgggcagaaaccgcagggatgggtttggcaaagcaagttcccccacaagttattcaactgaaggccagtgctacaccagtatcagtcagacagtaccccttgagtagagaggctcgagaaggaatttggccgcatgttcaaagattaatccaacagggcatcctagttcctgtccaatccccttggaatactcccctgctaccggttaggaagcctgggaccaatgattatcgaccagtacaggacttgagagaggtcaataaaagggtgcaggacatacacccaacggtcccgaacccttataacctcttgagcgccctcccgcctgaacggaactggtacacagtattggacttaaaagatgccttcttctgcctgagattacaccccactagccaaccactttttgccttcgaatggagagatccaggtacgggaagaaccgggcagctcacctggacccgactgccccaagggttcaagaactccccgaccatctttgacgaagccctacacagggacctggccaacttcaggatccaacaccctcaggtgaccctcctccagtacgtggatgacctgcttctggcgggagccaccaaacaggactgcttagaaggtacgaaggcactactgctggaattgtctgacctaggctacagagcctctgctaagaaggcccagatttgcaggagagaggtaacatacttggggtacagtttgcggggtgggcagcgatggctgacggaggcacggaagaaaactgtagtccagataccggccccaaccacagccaaacaagtgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccgaggagttttaacccaaaccctaggaccatggaggagacctgtcgcctacctgtcaaagaagcttgatcctgtagccagtggttggcccgtatgcctgaaggctatcgcagctgtggccatactggtcaaggacgctgacaaattgactttgggacagaatataactgtaatagccccccatgcattggagaacatcattcggcagcccccagaccgatggatgaccaacgcccgcatgacccactatcaaagcctgcttctcacagagagggtcactttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaggatggctggggcggcggtggtggacgggacccgcacgatctgggccagcagcctgccggaaggaacttcagcgcaaaaggctgagctcatggccctcacgcaagctttgcggctggccgaagggaaatccataaacatttatacggacagcaggtatgcctttgcgactgcacacgtacacggggccatctataaacaaagggggttgcttacctcagcagggagggaaataaagaacaaagaggaaattctaagcctattagaagccttacatttgccaaaaaggctagctattatacactgtcctggacatcagaaagccaaagatctcatatctagagggaaccagatggctgaccgggttgccaagcaggcagcccaggctgttaaccttctgcctataatagaaacgcccaaagccccagaacccagacgacagtacaccctagaagactggcaagagataaaaaagatagaccagttctctgagactccggaggggacctgctatacctcatatgggaaggaaatcctgccccacaaagaagggttagaatatgtccaacagatacatcgtctcacccacctaggaactaaacacctgcagcagttggtcagaacatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaaaaaaatactggaggaaatttttccgagatttggaatacctaaggtaatcgggtcagacaatggtccagcttttgttgcccaggtaagtcagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccctatgaattgctctacgggggaccccccccgttggtagaaattgcttctgtacatagtggtgatgtgctgctttcccagcctttgttctctaggctcaaggcgctcgagtgggtgaggcaacgagcgtggaagcagctccgggaggcctactcaggagaaggagacttgcaagttccacatcgcttccaagtgggagattcagtctatgttagacgccaccgtgcaggaaacctcgagactcggtggaagggcccttatctcgtacttttgaccacaccaacggctgtgaaagtcgaaggaatctccacctggatccatgcatcccacgttaagctggcgccacctcccgactcggggtggagagccgaaaagactgagaatccccttaagcttcgcctccatcgcctggttccttactctaacaataactccccaggccagtagtaaacgccttatagacagctcgaacccccatagacctttatcccttacctggctgattattgaccctgatacgggtgtcactgtaaatagcactcgaggtgttgctcctagaggcacctggtggcctgaactgcatttctgcctccgattgattaaccccgctgttaaaagcacacctcccaacctagtccgtagttatgggttctattgctgcccaggcacagagaaagagaaatactgtgggggttctggggaatccttctgtaggagatggagctgcgtcacctccaacgatggagactggaaatggccgatctctctccaggaccgggtaaaattctcctttgtcaattccggcccgggcaagtacaaagtgatgaaactatataaagataagagctgctccccatcagacttagattatctaaagataagtttcactgaaaaaggaaacaggaaaatattcaaaagtggataaatggtatgagctggggaatagttttttataaatatggcgggggagcagggtccactttaaccattcgccttaggatagagacggggacagaaccccctgtggcagtgggacccgataaagtactggctgaacaggggcccccggccctggagccaccgcataacttgccggtgccccaattaacctcgctgcggcctgacataacacagccgcctagcaacggtaccactggattgattcctaccaacacgcctagaaactccccaggtgttcctgttaagacaggacagagactcttcagtctcatccagggagctttccaagccatcaactccaccgaccctgatgccacttcttcttgttggctttgtctatcctcagggcctccttattatgaggggatggctaaagaaggaaaattcaatgtgaccaaagagcatagaaatcaatgtacatgggggtcccgaaataagcttaccctcactgaagtttccgggaaggggacatgcataggaaaagctcccccatcccaccaacacctttgctatagtactgtggtttatgagcaggcctcagaaaatcagtatttagtacctggttgtaacaggtggtgggcatgcaatactgggttaaccccctgtgtttccacctcagtcttcaaccaatccaaagatttctgtgtcatggtccaaatcgtcccccgagtgtactaccatcctgaggaagtggtccttgatgaatatgactatcggtataaccgaccaaaaagagaacccgtatcccttaccctagctgtaatgctcggattagggacggccgttggcgtaggaacagggacagctgccctgatcacaggaccacagcagctagagaaaggacttggtgagctacatgcggccatgacagaagatctccgagccttagaggagtctgttagcaacctagaagagtccctgacttctttgtctgaagtggttctacagaaccggaggggattagatctgctgtttctaagagaaggtgggttatgtgcagccttaaaagaagaatgttgcttctatgtagatcactcaggagccatcagagactccatgagcaagcttagagaaaggttagagaggcgtcgaagggaaagagaggctgaccaggggtggtttgaaggatggttcaacaggtctccttggatgaccaccctgctttctgctctgacgggacccctagtagtcctgctcctgttacttacagttgggccttgcttaattaataggtttgttgcctttgttagagaacgagtgagtgcagtccagatcatggtacttaggcaacagtaccaaggccttctgagccaaggagaaactgacctctagccttcccagttctaagattagaactattaacaagacaagaagtggggaatgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgacagccctagtgacctatctcaactgcaatctgtcactctgcccaggagcccacgcagatgcggacctccggagctattttaaaatgattggtccacggagcgcgggctctcgatattttaaaatgattggtccacggagcgcgggctctcgatattttaaaatgattggtttgtgacgcacaggctttgttgtgaaccccataaaagctgtcccgattccgcactcggggccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgagggggattgttcttttactggcctttcagtttccagtcttacaagtaggtctttaatccaatttgagtttattttttacagaatgtgagaagatattctaacatcattctttaacatttaggtgtccattttcccccattaccaattattggaagagactgtctt

SEQ ID NO: 263 - DNA, 9758 bp, artificial
  9_B sequence
gtccaaaattaagatgccagtgttacggcagatacccagcagccctgtgctgtagcataccagttccagcagctctgtggctgtagtggatcagctcttttacccggtgagaaaccaagcaagcactcggagagttggagaactcaggtttattacgccggcgggctcagaggagatcgctctccagagtctgagcccggaagaagggtttcacaaggcttttatgggctacgtcttccgggtccaagcttggctagttggactggagtgatgtcaggcaaggtagtagatgtggaaacaaatttacagaagcagatgcatgggggaggactggttggggcagttggctagactttgcttagtcatcatggctggggtctctcctttctacattttattgggacattttctcctacaccagctgatttgatctttgatcccttgcatagttgaaggggtgtcttttataaaagcactaatcccattcataaggctccacctgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaactgattacacattgacagccctagtgacctatctcaactgcaatctgtcactctgcccaggagcccacgcagatgcggacctccggagctattttaaaatgattggtccacggagcgcgggctctcgatattttaaaatgattggtccacggagcgcgggctctcgatattttaaaatgattggtttgtgacgcacaggctttgttgtgaaccccataaaagctgtcccgattccgcactcggggccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgaggggattgtcttttactggcctttcatttggtgcgttggccgggaaaccctgcgaccaccccttacacccgagaaccgacttggaggtaaagggatcccctttggaacgtgtgtgtgtcggccggcgtctctgttctgagtgtctgttttcggtgatgcgcgctttcggtttgcagctgtcctctcagaccgtaaggactggaggactgtgatcagcagacgtgctaggaggatcacaggctgccaccctgggggacgccccgggaggtggggagagccagggacgcctggtggtctcctactgtcggtcagaggaccgagttctgttgttgaagcgaaagcttccccctccgcggccgtccgactcttttgcctgcttgtggaagacgcggacgggtcgcgtgtgtctggatctgttggtttctgtttcgtgtgtctttgtcttgtgcgtccttgtctacagttttaatatgggacagacagtgacgaccccccttagtttgactctcgaccattggactgaagttagatccagggctcataatttgtcagttcaggttaagaagggaccttggcagactttctgtgcctctgaatggccaacattcgatgttggatggccatcagaggggacctttaattctgaaattatcctggctgttaaggcaatcatttttcagactggacccagctctcatcctgatcaggagccctatatccttacgtggcaagatttggcagaagatcctccgccatgggttaaaccatggctaaataaaccaagaaagccaggtccccgaatcctggctcttggagagaaaaacaaacactcggccgaaaaagtcgagccctctcctcgtatctaccccgagatcgaggagccgccgacttggccggaaccccaacctgttcccccacccccttatccagcacagggtgctgtgaggggaccctctgcccctcctggagctccggtggtggagggacctgctgccgggactcggagccggagaggcgccaccccggagcggacagacgagatcgcgatattaccgctgcgcacctatggccctcccatgccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaatttggctaaggtaagagaggtgatgcagggaccgaacgaacctccctcggtatttcttgagaggctcatggaagccttcaggcggttcaccccttttgatcctacctcggaggcccagaaagcctcagtggccctggccttcattgggcagtcggctctggatatcagaaagaaacttcagagactggaagggttacaggaggctgagttacgtgatctagtgagagaggcagagaaggtgtattacagaagggagacagaagaggagaaggaacagagaaaagaaaaggagagagaagaaagggaggaaagacgtgatagacggcaagagaagaatttgactaagatcttggccgcagtggttgaagggaagagcagcagggagagagagagagattttaggaaaattaggtcaggccctagacagtcagggaacctgggcaataggaccccactcgacaaggaccagtgtgcgtattgtaaagaaaaaggacactgggcaaggaactgccccaagaagggaaacaaaggaccgaaggtcctagctctagaagaagataaagattaggggagacggggttcggaccccctccccgagcccagggtaactttgaaggtggaggggcaaccagttgagttcctggttgataccggagcggagcattcagtgctgctacaaccattaggaaaactaaaagaaaaaaaatcctgggtgatgggtgccacagggcaacggcagtatccatggactacccgaagaaccgttgacttggcagtgggatgggtaacccactcgtttctggtcatccctgagtgcccagtaccccttctaggtagagacttactgaccaagatgagagctcaaatttcttttgaacaaggaagaccagaagtgtctgtgaataacaaacccatcactgtgttgaccctccaattagatgatgaatatcgactatattctccccaagtaaagcctgatcaagatatacagtcctggttggagcagtttccccaagcctgggcagaaaccacagggatgggtttggcaaagcaagttcccccacaggttattcaactgaaggccagtgctacaccagtatcagtcagacagtaccccttgagtagagaggctcgagaaggaatttggccgcatgttcaaagattaatccaacagggcatcctagttcctgtccaatccccttggaatactcccctgctaccggttaggaagcctgggaccaatgattatcgaccagtacaggacttgagagaggtcaataaaagggtgcaggacatacacccaacggtcccgaacccttataacctcttgagcgccctcccgcctgaacggaactggtacacagtattggacttaaaagatgccttcttctgcctgagattacaccccactagccaaccgctttttgccttcgaatggagagatccaggtacgggaagaaccgggcagctcacctggacccgactgccccaagggttcaagaactccccgaccatctttgacgaagccctacacagggacctggccaacttcaggatccaacaccctcaggtgaccctcctccagtacgtggatgacctgcttctggcgggagccaccaaacaggactgcttagaaggtacgaaggcactactgctgaaattgtctgacctaggctacagagcctctgctaagaaggcccagatttgcaggagagaggtaacatacttggggtacagtttgcggggcgggcagcgatggctgacggaggcacggaagaaaactgtagtccagataccggccccaaccacagccaaacaagtgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccgaggagttttaacccaaaccctaggaccatggaggagacctgttgcctacctgtcaaagaagcttgatcctgtagccagtggttggcccgtatgcctgaaggctatcgcagctgtggccatactggtcaaggacgctgacaaattgactttgggacagaatataactgtaatagccccccatgcattggagaacatcgttcggcagcccccagaccgatggatgaccaatgcccgcatgacccactatcaaagcctgcttctcacagagagggtcactttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaggatggctgggacggcggtggtggacgggacccacacgatctgggccagcagcctgccggaaggaacttcagcgcaaaaggctgagctcatggccctcacgcaagctttgcggctggccgaagggaaatccataaacatttatacggacagcaggtatgcctttgcgactgcacacgtacacggggccatctataaacaaagggggttgcttacctcagcagggagggaaataaagaacaaagaggaaattctaagcctattagaagccttacatttgccaaaaaggctagctattatacactgtcctggacatcagaaagccaaagatctcatatctagagggaaccagatggctgaccgggttgccaagcaggcagcccaggctgttaaccttctgcctataatagaaacgcccaaagccccagaacccagacgacagtacaccctagaagactggcaagagataaaaaagatagaccagttctctgagactccggaggggacctgctatacctcatatgagaaggaaatcctgccccacaaagaagggttagaatatgtccaacagatacatcgtctcacccacctaggaactaaacacctgcagcagttggtcagaacatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaaaaaaatactggaggaaatttttccgagatttggaatacctaaggtaatcgggtcagacaatggtccagcttttgttgcccaggtaagtcagggactggccaagatattggggattgattgaaaactgcattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccctatgaattgctctacgggggaccccccccgttggtagaaattgcttctgtacatagtgctgatgtgctgctttcccagcctttgttctctaggctcaaggcgctcgagtgggtgaggcaacgagcgtggaagcagctccgggaggcctactcaggagaaggagacttgcaagttccacatcgcttccaagtgggagattcagtctatgttagacgccaccgtgcaggaaacctcgagactcggtggaagggcccttatctcgtacttttgaccacaccaacggctgtgaaagtcgaaggaatctccacctggatccatgcatcccacgttaagctggcgccacctcccgactcggggtggagagccgaaaagactgagaatccccttaagcttcgcctccatcgcctggttccttactctaacaataactccccaggccagtagtaaacgccttatagacagctcgaacccccatagacctttatcccttacctggctgattattgaccctgatacgggtgtcactgtaaatagcactcgaggtgttgctcctagaggcacctggtggcctgaactgcatttctgcctccgattgattaaccccgctgttaaaagcacacctcccaacctagtccgtagttatgggttctattgctgcccaggcacagagaaagagaaatactgtgggggttctggggaatccttctgtaggagatggagctgtgtcacctccaacgatggagactggaaatggccgatctctctccaggaccgggtaaaattctcctttgtcaattccggcccgggcaagtacaaagtgatgaaactatataaagataagagctgctccccatcagacttagattatctaaagataagtttcactgaaaaaagaaaacaggaaaatattcaaaagtggataaatggtatgagctggggaatagttttttataaatatggcgggggagcagggtccactttaaccattcgccttaggatagagacggggacagaaccccctgtggcagtgggacccgataaagtactggctgaacaggggcccccggccctggagccaccgcataacttgccggtgccccaattaacctcgctgcggcctgacataacacagccgcctagcaacggtaccactggattgattcctaccaacacgcctagaaactccccaggtgttcctgttaagacaggacagagactcttcagtctcatccagggagctttccaagccatcaactccaccgaccctgatgccacttcttcttgttggctttgtctatcctcagggcctccttattatgaggggatggctaaagaaggaaaattcaatgtgaccaaagagcatagaaatcaatgtacatgggggtcccaaaataagcttaccctcactgaagtttccgggaaggggacatgcataggaaaagctcccccatcccaccaacacctttgctatagtactgtggtttatgagcaggcctcagaaaatcagtatttagtacctggttataacaggtggtgggcatgcaatactgggttaaccccctgtgtttccacctcagtcttcaaccaatccaaaaatttctgtgtcatggtccaaatcgtcccccgagtgtactaccatcctgagaaagtggtccttgatgaatatgactatcggtataaccgaccaaaaagagaacccgtatcccttaccctagctgtaatgctcggattagggacggccgttggcgtaggaacagggacagctgccctgatcacaggaccacagcagctagagaaaggacttggtgaactacatgcggccatgacagaagatctccgagccttagaggagtctgttagcaacctagaagagtccctgacttctttgtctgaagtggttctacagaaccggaggggattagatctgctgtttctaagagaaggtgggttatgtgcagccttaaaagaagaatgttgcttctatgtagatcactcaggagccatcagagactccatgagcaagcttagagaaaggttagagaggcgtcgaagggaaagagaggctgaccaggggtggtttgaaggatggttcaacaggtctccttggatgaccaccctgctttctgctctgacgggacccctagtagtcctgctcctgttacttacagttgggccttgcttaattaataggtttgttgcctttgttagagaacgagtgagtgcagtccagatcatggtacttaggcaacagtaccaaggccttctgagccaaggagaaactgacctctagccttcccagttctaagattagaactattaacaagacaagaagtggggaatgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgacagccctagtgacctatctcaactgcaatctgtcactctgcccaggagcccacgcagatgcggacctccggagctattttaaaatgattggtccacggagcgcgggctctcgatattttaaaatgattggtccacggagcgcgggctctcgatattttaaaatgattggtttgtgacgcacaggctttgttgtgaaccccataaaagctgtcccgattccgcactcggggccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgagggggattgttcttttactggcctttcacaccctcatggccagatcatgtcccaaggtccttgtctccaaacaccatcactttgggggttaggatttccacatatgaatttgacaggatgcagacatcaggtttatgcagcagctatcttataactttgagatgtctctgcctttataaagatcaaaataatgaaagtcagagttttcagtaatcagctctagtgagtcaaatagcaaagattagaatttatacccgattccagatttttccatttgacatttgtggcttttctatttctcatacctggcaatcctcatctctcttgtggaaatggtcaatcatttgttgggtccaaataataatatcccagtaatcctcagcaaccagtggtaacatgacttagtgactgatgtctctgttctctgtatggactcatcatcccctccccaggatccctggaccctcactcacattgccacactttcatcttggcccttaacacctgccaaagggacacagagccctt

SEQ ID NO: 264 - DNA, 9325 bp, artificial
  10_B sequence
gttgtgtttgtgggagagggcgagcgtgtccccctactcctccgccatcttgtcctctctctttatgcattttgaatattaactccttatcaggcatatgtctgaaaatatattttcagtttgtcaatatttttctttgctgtgcaaaaacttttaactttaactagatcacatttgtttattttgcttttatttcccttacctgaggtgacagatccaagcaaatattgctaagatttttgtcaaagagtgtactgcctatgttcttctaggaattttatggttttgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgacagccctagtgacctatctcaactgcaatctgtcactctgcccaggagcccacgcagatgcggacctccggagctattttaaaatgattggtccacggagcgcgggctctcgatattttaaaatgattggtccacggagcgcgggctctcgatattttaaaatgattggtttgtgacgcacaggctttgttgtgaaccccataaaagctgtcccgattccgcactcggggccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgagggggattgttcttttactggcctttcatttggtgcgttggccgggaaatcctgcgaccaccccttacacccgagaaccgacttggaggtaaagggatcccctttggaacgtgtgtgtgtgtcggccggcgtctctgttctgagtgtctgttttcggtgatgcgcgctttcggtttacagctgtcctctcagaccgtaaggactggaggactgtgatcagcagacgtgctaggaggatcacaggctgccaccctgggggacgccccgggaggtggggagagccagggacgcctggtggtctcctactgtcggtcagaggaccgagttctgttgttgaagcgaaagcttccccctccgcggccgtccgactcttttgcctgcttgtggaagacgcggacgggtcgcgtgtgtctggatctgttggtttctgtttcgtgtgtctttgtcttgtgcgtccttgtctacagttttaatatgggacagacagtgacgaccccccttagtttgactctcgaccattggactgaagttagatccagggctcataatttgtcagttcaggttaagaagggaccttggcagactttctgtgcctctgaatggccaacattcgatgttggatggccatcagaggggacctttaattctgaaattatcctggctgttaaggcaatcatttttcagactggacccggctctcatcctgatcaggagccctatatccttacgtggcaagatttggcagaagatcctccgccatgggttaaaccatggctaaataaaccaagaaagccaggtccccgaatcctggctcttggagagaaaaacaaacactcggccgaaaaagtcgagccctctcctcgtatctaccccgagatcgaggagccgccgacttggccggaaccccaacctgttcccccacccccttatccagcacagggtgctgtgaggggaccctctgcccctcctggagctccggtggtggagggacctgctgccgggactcggagccggagaggcgccaccccggagcggacagacgagatcgcgatattaccgctgcgtacctatggccctcccatgccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagtgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaatttggctaaggtaagagaggtgatgcagggaccgaacgaacctccctcggtatttcttgagaggctcatggaagccttcaggcggttcaccccttttgatcctacctcggaggcccagaaagcctcagtggccctggccttcattgggcagtcggctctggatatcagaaagaaacttcagagactggaagggttacaggaggctgagttacgtgatctagtgagagaggcagagaaggtgtattacagaagggagacagaagaggagaaggaacagagaaaagaaaaggagagagaagaaagggaggaaagacgtgatagacggcaagagaagaatttgactaagatcttggccgcagtggttgaagggaagagcagcagggagagagagagagattttaggaaaattaggtcaggccctagacagtcagggaacctgggcaataggaccccactcgacaaggaccagtgtgcgtattgtaaagaaaaaggacactgggcaaggaactgccccaagaagggaaacaaaggaccgaaggtcctagctctagaagaagataaagattaggggagacggggttcggaccccctccccgagcccagggtaactttgaaggtggaggggcaaccagttgagttcctggttgataccggagcggagcattcagtgctgctacaaccattaggaaaactaaaagaaaaaaaatcctgggtgatgggtgccacagggcaacggcagtatccatggactacccgaagaaccgttgacttgggagtgggacgggtaacccactcgtttctggtcatccctgagtgcccagtaccccttctaggtagagacttactgaccaagatgggagctcaaatttcttttgaacaaggaagaccagaagtgtctgtgaataacaaacccatcactgtgttgaccctccaattagatgatgaatatcgactatattctccccaagtaaagcctgatcaagatatacagtcctggttggagcagtttccccaagcctgggcagaaaccgcagggatgggtttggcaaagcaagttcccccacaggttattcaactgaaggccagtgctacaccagtatcagtcagacagtaccccttgagtagagaggctcgagaaggaatttggccgcatgttcaaagattaatccaacagggcatcctagttcctgtccaatccccttggaatactcccctgctaccggttaggaagcctgggaccaatgattatcgaccagtacaggacttgagagaggtcaataaaagggtgcaggacatacacccaacggtcccgaacccttataacctcttgagcgccctcccgcctgaacggaactggtacacagtattggacttaaaagatgccttcttctgcctgagattacaccccactagccaaccactttttgccttcgaatggagagatccaggtacgggaagaaccgggcagctcacctggacccgactgccccaagggttcaagaactccccgaccatctttgacgaagccctacacagggacctggccaacttcaggatccaacaccctcaggtgaccctcctccagtacgtggatgacctgcttctggcgggagccaccaaacaggactgcttagaaggtacgaaggcactactgctggaattgtctgacctaggctacagagcctctgctaagaaggcccagatttgcaggagagaggtaacatacttggggtacagtttgcggggtgggcagcgatggctgacggaggcacggaagaaaactgtagtccagataccggccccaaccacagccaaacaagtgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccgaggagttttaacccaaaccctaggaccatggaggagacctgtcgcctacctgtcaaagaagcttgatcctgtagccagtggttggcccgtatgcctgaaggctatcgcagctgtggccatactggtcaaggacgctgacaaattgactttgggacagaatataactgtaatagccccccatgcattggagaacatcattcggcagcccccagaccgatggatgaccaacgcccgcatgacccactatcaaagcctgcttctcacagagagggtcactttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaggatggctggggcggcggtggtggacgggacccgcacgatctgggccagcagcctgccggaaggaacttcagcgcaaaaggctgagctcatggccctcacgcaagctttgcggctggccgaagggaaatccataaacatttatacggacagcaggtatgcctttgcgactgcacacgtacacggggccatctataaacaaagggggttgcttacctcagcagggagggaaataaagaacaaagaggaaattctaagcctattagaagccttacatttgccaaaaaggctagctattatacactgtcctggacatcagaaagccaaagatctcatatctagagggaaccagatggctgaccgggttgccaagcaggcagcccaggctgttaaccttctgcctataatagaaacgcccaaagccccagaacccagacgacagtacaccctagaagactggcaagagataaaaaagatagaccagttctctgagactccggaggggacctgctatacctcatatgggaaggaaatcctgccccacaaagaagggttagaatatgtccaacagatacatcgtctcacccacctaggaactaaacacctgcagcagttggtcagaacatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaaaaaaatactggaggaaatttttccgagatttggaatacctaaggtaatcgggtcagacaatggtccagcttttgttgcccaggtaagtcagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccctatgaattgctctacgggggaccccccccgttggtagaaattgcttctgtacatagtggtgatgtgctgctttcccagcctttgttctctaggctcaaggcgctcgagtgggtgaggcaacgagcgtggaagcagctccgggaggcctactcaggagaaggagacttgcaagttccacatcgcttccaagtgggagattcagtctatgttagacgccaccgtgcaggaaacctcgagactcggtggaagggcccttatctcgtacttttgaccacaccaacggctgtgaaagtcgaaggaatctccacctggatccatgcatcccacgttaagctggcgccacctcccgactcggggtggagagccgaaaagactgagaatccccttaagcttcgcctccatcgcctggttccttactctaacaataactccccaggccagtagtaaacgccttatagacagctcgaacccccatagacctttatcccttacctggctgattattgaccctgatacgggtgtcactgtaaatagcactcgaggtgttgctcctagaggcacctggtggcctgaactgcatttctgcctccgattgattaaccccgctgttaaaagcacacctcccaacctagtccgtagttatgggttctattgctgcccaggcacagagaaagagaaatactgtgggggttctggggaatccttctgtaggagatggagctgcgtcacctccaacgatggagactggaaatggccgatctctctccaggaccgggtaaaattctcctttgtcaattccggcccgggcaagtacaaagtgatgaaactatataaagataagagctgctccccatcagacttagattatctaaagataagtttcactgaaaaaggaaacaggaaaatattcaaaagtggataaatggtatgagctggggaatagttttttataaatatggcgggggagcagggtccactttaaccattcgccttaggatagagacggggacagaaccccctgtggcagtgggacccgataaagtactggctgaacaggggcccccggccctggagccaccgcataacttgccggtgccccaattaacctcgctgcggcctgacataacacagccgcctagcaacggtaccactggattgattcctaccaacacgcctagaaactccccaggtgttcctgttaagacaggacagagactcttcagtctcatccagggagctttccaagccatcaactccaccgaccctgatgccacttcttcttgttggctttgtctatcctcagggcctccttattatgaggggatggctaaagaaggaaaattcaatgtgaccaaagagcatagaaatcaatgtacatgggggtcccgaaataagcttaccctcactgaaatttccgggaaggggacatgcataggaaaagctcccccatcccaccaacacctttgctatagtactgtggtttatgagcaggcctcagaaaatcagtatttagtacctggttgtaacaggtggtgggcatgcaatactgggttaaccccctgtgtttccacctcagtcttcaaccaatccaaagatttctgtgtcatggtccaaatcgtcccccgagtgtactaccatcctgaggaagtggtccttgatgaatatgactatcggtataaccgaccaaaaagagaacccgtatcccttaccctagctgtaatgctcggattagggacggccgttggcgtaggaacagggacagctgccctgatcacaggaccacagcagctagagaaaggacttggtgagctacatgcggccatgacagaagatctccgagccttagaggagtctgttagcaacctagaagagtccctgacttctttgtctgaagtggttctacagaaccggaggggattagatctgctgtttctaagagaaggtgggttatgtgcagccttaaaagaagaatgttgcttctatgtagatcactcaggagccatcagagactccatgagcaagcttagagaaaggttagagaggcgtcgaagggaaagagaggctgaccaggggtggtttgaaggatggttcaacaggtctccttggatgaccaccctgctttctgctctgacgggacccctagtagtcctgctcctgttacttacagttgggccttgcttaattaataggtttgttgcctttgttagagaacgagtgagtgcagtccagatcatggtacttaggcaacagtaccaaggccttctgagccaaggagaaactgacctctagccttcccagttctaagattagaactattaacaagacaagaagtggggaatgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgacagccctagtgacctatctcaactgcaatctgtcactctgcccaggagcccacgcagatgcggacctccggagctattttaaaatgattggtccacggagcgcgggctctcgatattttaaaatgattggtccacggagcgcgggctctcgatattttaaaatgattggtttgtgacgcacaggctttgttgtgaaccccataaaagctgtcccgattccgcactcggggccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgagggggattgttcttttactggcctttcagtttccagtcttacaagtaggtctttaatccaatttgagtttattttttacagaatgtgagaagatattctaacatcattctttaacatttaggtgtccattttccccattaccaattattgaagagactgtctttcctccattgtatattttgacctctttgtcaaagattaattgaatatatgtgtgtgggtttatttctgggctctctattcagttccattgatatgtgtatctgtttttgtgccagtaatatactgttttgattttattgtggc

SEQ ID NO: 265 - DNA, 9760 bp, artificial
  11_B sequence
tgttataatgattttggaacaatgatacagaaaagaagcagaataatgatgggtgctaagttcctatttgcagccagtgaagaatacattttaaaaaaggccatgaaaagatgggcaggctgaaaataaactgaaatcataaggacaaaaatgatgaggaactaagtcaggtatgtacctaaaggacatgtaaagaattaaaagtagctgataaaagtttggcattagcaaactgacctcaggttaggctttatggggtaagttaaagaagttaaaatggggttctttcaattttcctttttgctcactggaatgcatgcattgattctactcaatggatcctgagcttgagaggatgaagaaagacagtgctccctaagagctctcttgatcctatgcattggactatattgaagttattgtagtggccaatgcacaaatacatgccatgggaaagacctaatataaataggcaacaacagattgaaagaccttgcttttgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgacagccctagtgacctatctcaactgcaatctgtcactctgcccaggagcccacgcagatgcggacctccggagctattttaaaatgattggtccacggagcgcgggctctcgatattttaaaatgattggtccacggagcgcgggctctcgatattttaaaatgattggtttgtgacgcacaggctttgttgtgaaccccataaaagctgtcccgattccgcactcggggccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgagggggattgttcttttactggcctttcatttggtgcgttggccgggaaatcctgcgaccaccccttacacccgagaaccgacttggaagtaaagggatcccctttggaacgtgtgtgtgtgtcggccggcgtctctgttctgagtgtctgttttcggtgatgcgcgctttcggtttgcagctgtcctctcagaccgtaaggactggaggactgtgatcagcagacgtgctaggaggatcacaggctgccaccctgggggacgccccgggaggtggggagagccagggatgcctggtggtctcctactgtcagtcagaggaccgagttctgttgttgaagcgaaagcttccccctccgcggccgtccgactcttttgcctgcttgtggaagacgcggacgggtcgcgtgtgtctggatctgttggtttctgtttcgtgtgtctttgtcttgtgcgtccttgtctacagttttaatatgggacagacagtgacgaacccccttagtttgactctcgaccattggactgaagttagatccagggctcataatttgtcagttcaggttaagaagggaccttggcagactttctgtgcctctgaatggccaacattcgatgttggatggccatcagaggggacctttaattctgaaattatcctggctgttaaggcaatcatttttcagactggacccggatctcatcctgatcaggagccctatatccttacgtggcaagatttggcagaagatcctccgccatgggttaaaccatggctaaataaaccaagaaagccaggtccccgaatcctggctcttggagagaaaaacaaacactcggccgaaaaagtcgagccctctcctcgtatctaccccgagatcgaggagccgccgacttggccggaaccccaacctgttcccccacccccttatccagcacagggtgctgtgaggggaccctctgcccctcctggagctccggtggtggagggacctgctgccgggactcggagccggagaggcgccaccccggagcggacagacgagatcgcgatattaccgctgcgcacctatggccctcccatgccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaatttggctaaggtaagagaggtgatgcagggaccgaacgaacctccctcggtatttcttgagaggctcatggaagccttcaggcggttcaccccttttgatcctacctcggaggcccagaaagcctcagtggccctggccttcattgggcagtcggctctggatatcagaaagaaacttcagagactggaagggttacaggaggctgagttacgtgatctagtgagagaggcagagaaggtgtattacagaagggagacagaagaggagaaggaacagagaaaagaaaaggagagagaagaaagggaggaaagacatgatagacggcaagagaagaatttgactaagatcttggccgcagtggttgaagggaagagcagcagggagagagagagagattttaggaaaattaggtcaggccctagacagtcagggaacctgggcaataggaccccactcgacaaggaccagtgtgcgtattgtaaagaaaaaggacactgggcaaggaactgccccaagaagagaaacaaaggaccgaaggtcctagctctagaagaagataaagattaggggagacggggttcggaccccctccccgagcccagggtaactttgaaggtggaggggcaaccagttgagttcctggttgataccggagcggagcattcagtgctgctacaaccattaggaaaactaaaagaaaaaaaatcctgggtgatgggtgccacagggcaacggcagtatccatggactacccgaagaaccgttgacttgggagtgggacgggtaacccactcgtttctggtcatccctgagtgcccagtaccccttctaggtagagacttactgaccaagatgggagctcaaatttcttttgaacaaggaagaccagaagtgtctgtgaataacaaacccatcactgtgttgaccctccaattagatgatgaatatcgactatattctccccaagtaaagcctgatcaagatatacagtcctggttggagcagtttccccaagcctgggcagaaaccgcagggatgggtttggcaaagcaagttcccccacaggttattcaactgaaggccagtgctacaccagtatcagtcagacagtaccccttgagtagagaggctcgagaaggaatttggccgcatgttcaaagattaatccaacagggcatcctagttcctgtccaatccccttggaatactcccctgctaccggttaggaagcctgggaccaatgattatcgaccagtacaggacttgagagaggtcaataaaagggtgcaggacatacacccaacggtcccgaacccttataacctcttgagcgccctcccgcctgaacggaactggtacacagtattggacttaaaagatgccttcttctgcctgagattacaccccactagccaaccactttttgccttcgaatggagagatccaggtacgggaagaaccgggcagctcacctggacccgactgccccaagggttcaagaactccccgaccatctttgacgaagccctacacagggacctggccaacttcaggatccaacaccctcaggtgaccctcctccagtacgtggatgacctgcttctggcgggagccaccaaacaggactgcttagaaggtacgaaggcactactgctggaattgtctgacctaggctacagagcctctgctaagaaggcccagatttgcaggagagaggtaacatacttggggtacagtttgcggggcgggcagcgatggctgacggaggcatggaagaaaactgtagtccagataccggccccaaccacagccaaacaagtgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccgaggagttttaacccaaacgctaggaccatggaggagacctgttgcctacctgtcaaagaagcttgatcctgtagccagtggttggcccgtatgcctgaaggctatcgcagctgtggccatactggtcaaggacgctgacaaattgactttgggacagaatataactgtaatagccccccatgcattggagaacatcgttcggcagcccccagaccgatggatgaccaacgcccgcatgacccactatcaaagcctgcttctcacagagagggtcactttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaggatggctggggcggcggtggtggacgggacccgcacgatctgggccagcagcctgccggaaggaacttcagcgcaaaaggctagctcatggccctcacgcaagctttgcggctggccgaagggaaatccataaacatttatacggacagcaggtatgcctttgcgactgcacacgtacacggggccatctataaacaaagggggttgcttacctcagcagggagggaaataaagaacaaagaggaaattctaagcctattagaagccttacatttgccaaaaaggctagctattatacactgtcctggacatcagaaagccaaagatctcatatctagagggaaccagatggctgaccgggttgccaagcaggcagcccaggctgttaaccttctgcctataatagaaacgcccaaagccccagaacccagacgacagtacaccctagaagactggcaagagataaaaaagatagaccagttctctgagactccggaggggacctgctatacctcatatgggaaggaaatcctgccccacaaagaagggttagaatatgtccaacagatacatcgtctcacccacctaggaactaaacacctgcagcagttggtcagaacatccccttatcatgttctgaggctaccaggagtggctgactcggtggtcaaacattgtgtgccctgccagctggttaatgctaatccttccagaatacctccagggaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaaaaaaatactggaggaaatttttccgagatttggaatacctaaggtaatcgggtcagacaatggtccagcttttgttgcccaggtaagtcagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccctatgaattgctctacgggggacccccccgttggtagaaattgcttctgtacatagtgctgatgtgctgctttcccagcctttgttctctaggctcaaggcgctcgagtgggtgaggcaacaagcgtggaagcagctccgggaggcctactcaggagaaggagacttgcaagttccacatcgcttccaagtgggagattcagtctatgttagacgccaccgtgcaggaaacctcgagactcggtggaagggcccttatctcgtacttttgaccacaccaacggctgtgaaagtcgaaggaatctccacctggatccatgcatcccacgttaagctggcgccacctcccgactcggggtggagagccgaaaagactgagaatccccttaagcttcgcctccatcgcctggttccttactctaacaataactccccaggccagtagtaaacgccttatagacagctcgaacccccatagacctttatcccttacctggctgattattgaccctgatacgggtgtcactgtaaatagcactcgaggtgttgctcctagaggcacctggtggcctgaactgcatttctgcctccgattgattaaccccgctgttaaaagcacacctcccaacctagtccgtagttatgggttctattgctgcccaggcacagagaaagagaaatactgtgggggttctggggaatccttctgtaggagatggagctgcgtcacctccaacgatggagactggaaatggccgatctctctccaggaccgggtaaaattctcctttgtcaattccggcccgggcaagtacaaagtgatgaaactatataaagataagagctgctccccatcagacttagattatctaaagataagtttcactgaaaaaggaaaacaggaaaatattcaaaagtggataaatggtatgagctggggaatagttttttataaatatggcgggggagcagggtccactttaaccattcgccttaggatagagacggggacagaaccccctgtggcagtgggacccgataaagtactggctgaacaggggcccccggccctggagccaccgcataacttgccggtgccccaattaacctcgctgcggcctgacataacacagccgcctagcaacggtaccactggattgattcctaccaacacgcctagaaactccccaggtgttcctgttaagacaggacagagactcttcagtctcatccagggagctttccaagccatcaactccaccgaccctgatgccacttcttcttgttggctttgtctatcctcagggcctccttattatgaggggatggctaaagaaggaaaattcaatgtgaccaaagagcatagaaatcaatgtacatgggggtcccgaaataagcttaccctcactgaagtttccgggaaggggacatgcataggaaaagctcccccatcccaccaacacctttgctatagtactgtggtttatgagcaggcctcagaaaatcagtatttagtacctggttataacaggtggtgggcatgcaatactgggttaaccccctgtgtttccacctcagtcttcaaccaatccaaagatttctgtgtcatggtccaaatcgtcccccgagtgtactaccatcctgaggaagtggtccttgatgaatatgactatcggtataaccgaccaaaaagagaacccgtatcccttaccctagctgtaatgctcggattagggacggccgttggcgtaggaacagggacagctgccctgatcacaggaccacagcagctagagaaaggacttggtgagctacatgcggccatgacagaagatctccgagccttagaggagtctgttagcaacctagaagagtccctgacttctttgtctgaagtggttctacagaaccggaggggattagatctgctgtttctaagagaaggtgggttatgtgcagccttaaaagaagaatgttgcttctatgtagatcactcaggagccatcagagactccatgagcaagcttagagaaaggttagagaggcgtcgaagggaaagagaggctgaccaggggtggtttgaaggatggttcaacaggtctccttggatgaccaccctgctttctgctctgacgggacccctagtagtcctgctcctgttacttacagttgggccttgcttaattaataggtttgttgcctttgttagagaacgagtgagtgcagtccagatcatggtacttaggcaacagtaccaaggccttctgagccaaggagaaactgacctctagccttcccagttctaagattagaactattaacaagacaagaagtggggaatgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgacagccctagtgacctatctcaactgcaatctgtcactctgcccaggagcccacgcagatgcggacctccggagctattttaaaatgattggtccacggagcgcgggctctcgatattttaaaatgattggtccacggagcgcgggctctcgatattttaaaatgattggtttgtgacgcacaggctttgttgtgaaccccataaaagctgtcccgattccgcactcggggccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgagggggattgttcttttactggcctttcactttcttgaaaaatatcttaatgtgagcttcttttgaatcatgtacagtataatttcttcgacttaaactagtcctctttcctttttcctcctgttgaaatactatatctcttaggatccaatttaaatattactgctttctttctgaagccttttcagttgctccactgtgcagaactgatgggtccctggtcagagttctcacagccgaccacccactcatgtatgtaaacaaacaggaattacattatgacttgttcgtgcccgtcttcctcattgtgagttccatgaagacaggagcaatgccttacagatctgcacatcctctagacccaatgcagtgcctcataccccatcgttcctcaacaattatttgcgggaaagaacgaataggtgaatcaatacacaaatgatgttgccactaaagtttccattcctctggagcctcttgaaccctagctgccctctagaaagttatttctcaaactgaggttagtgga

SEQ ID NO: 266 - DNA, 9757 bp, artificial
  12_B sequence
ctggagcaccggctcagatctctcagtgctttctttccttgcccagcaggagcaggtacataagacgtctgagcatttgagccaagactgggctctgctggcagcaacactccgtcatggagcccagtgatctgggtatgacgaaccctcgcctcttgtcctcagttggcaccgacgcccaggaatgcccagtggattgaaatcacacgatcctcccgcgactgccacctggagacagaattacagaaagggggataaagaatgcaagcactgtctcgtcattcaaactctaacatgtggttaaataagcctcacagactgcacatggaaattgaaatcaagccaggaaaaccccaatttttcacctgcctgtcacttcgcagacattccaagcgcggggtctgtcttccggggcctgggccctctgccttccttccatcatcttagagcaggtgctctcagactgcccttggcttgcatagctcgtgtcgtacttccagtgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgacagccctagtgacctatctcaactgcaatctgtcactctgcccaggagcccacgcagatgcggacctccggagctattttaaaatgattggtccacggagcgcgggctctcgatattttaaaatgattggtccacggagcgcgggctctcgatattttaaaatgattggtttgtgacgcacaggctttgttgtgaaccccataaaagctgtcccgattccgcactcggggcccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgagggggattgttcttttactggcctttcatttggtgcattggccgggaaaccctgcgaccaccccttacacccgagaaccgacttggaggtaaagggatcccctttggaacttgtgtgtgtgtcggccggcgtctctgttctgagtgtctgttttcggtgatgcgcgctttcggtttgcagctgtcctctcagaccgtaaggactggaggactgtgatcagcagacgtgctaggaggatcacaggctgccaccctgggggacgccccgggaggtggggagagccagggacgcctggtggtctcctactgtcggtcagaggaccgagttctgttgttgaagcgaaagcttccccctccgcggccgtccgactcttttgcctgcttgtggaagacgcggacgggtcgcgtgtgtctggatctgttggtttctgtttcgtgtgtctttgtcttgtgcgtccttgtctacagttttaatatgggacagacagtgacgaccccccttagtttgactctcgaccattggactgaagttagatccagggctcataatttgtcagttcaggttaagaagggaccttggcagactttctgtgcctctgaatggccaacattcgatgttggatggccatcagaggggacctttaattctgaaattatcctggctgttaaggcaatcatttttcagactggacccagctctcatcctgatcaggagccctatatccttacgtggcaagatttggcagaagatcctccgccatgggttaaaccatggctaaataaaccaagaaagccaggtccccgaatcctggctcttggagagaaaaacaaacactcggccgaaaaagtcgagccctctcctcgtatctaccccgagatcgaggagccgccgacttggccggaaccccaacctgttcccccacccccttatccagcacagggtgctgtgaggggaccctctgcccctcctggagctccggtggtggagggacctgctgccgggactcggagccggagaggcgccaccccggagcggacagacgagatcgcgatattaccgctgcgcacctatggccctcccatgccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaatttggctaaggtaagagaggtgatgcagggaccgaacgaacctccctcggtatttcttgagaggctcatggaagccttcaggcggttcaccccttttgatcctacctcggaggcccagaaagcctcagtggccctggccttcattgggcagtcggctctggatatcagaaagaaacttcagagactggaagggttacaggaggctgagttacgtgatctagtgagagaggcagagaaggtgtattacagaagggagacagaagaggagaaggaacagagaaaagaaaaggagagagaagaaagggaggaaagacgtgatagacggcaagagaagaatttgactaagatcttggccgcagtggttgaagggaagagcagcagggagagagagagagattttaggaaaattaggtcaggccctagacagtcagggaacctgggcaataggaccccactcgacaaggaccagtgtgcgtattgtaaagaaaaaggacactgggcaaggaactgccccaagaagggaaacaaaggaccgaaggtcctagctctagaagaagataaagattaggggagacggggttcggaccccctccccgagcccagggtaactttgaaggtggaggggcaaccagttgagttcctggttgataccggagcggagcattcagtgctgctacaaccattaggaaaactaaaagaaaaaaaatcctgggtgatgggtgccacagggcaacggcagtatccatggactacccgaagaaccgttgacttggcagtgggacgggtaacccactcgtttctggtcatccctgagtgcccagtaccccttctaggtagagacttactgaccaagatgggagctcaaatttcttttgaacaaggaagaccagaagtgtctgtgaataacaaacccatcactgtgttgaccctccaattagatgatgaatatcgactatattctccccaagtaaagcctgatcaagatatacagtcctggttggagcagtttccccaagcctgggcagaaaccgcagggatgggtttggcaaagcaagttcccccacaggttattcaactgaaggccagtgctacaccagtatcagtcagacagtaccccttgagtagagaggctcgagaaggaatttggccgcatgttcaaagattaatccaacagggcatcctagttcctgtccaatccccttggaatactcccctgctaccggttaggaagcctgggaccaatgattatcgaccagtacaggacttgagagaggtcaataaaagggtgcaggacatacacccaacggtcccgaacccttataacctcttgagcgccctcccgcctgaacggaactggtacacagtattggacttaaaagatgccttcttctgcctgagattacaccccactagccaaccgctttttgccttcgaatggagagatccaggtacgggaagaaccgggcagctcacctggacccgactgccccaagggttcaagaactccccgaccatctttgacgaagccctacacagggacctggccaacttcaggatccaacaccctcaggtgaccctcctccagtacgtggatgacctgcttctggcgggagccaccaaacaggactgcttagaaggtacgaaggcactactgctggaattgtctgacctaggctacagagcctctgctaagaaggcccagatttgcaggagagaggtaacatacttggggtacagtttgcggggcgggcagcgatggctgacggaggcacggaagaaaactgtagtccagataccggccccaaccacagccaaacaagtgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccgaggagttttaacccaaaccctaggaccatggaggagacctgttgcctacctgtcaaagaagcttgatcctgtagccagtggttggcccgtatgcctgaaggctatcgcagctgtggccatactggtcaaggacgctgacaaattgactttgggacagaatataactgtaatagccccccatgcattggagaacatcgttcggcagcccccagaccgatggatgaccaacgcccgcatgacccactatcaaagcctgcttctcacagagagggtcactttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaggatggctggggcggcggtggtggacgggacccacacgatctgggccagcagcctgccggaaggaacttcagcgcaaaaggctgagctcatggccctcacgcaagctttgcggctggccgaagggaaatccataaacatttatacggacagcaggtatgcctttgcgactgcacacgtacacggggccatctataaacaaagggggttgcttacctcagcagggagggaaataaagaacaaagaggaaattctaagcctattagaagccttacatttgccaaaaaggctagctattatacactgtcctggacatcagaaagccaaagatctcatatctagagggaaccagatggctgaccgggttgccaagcaggcagcccaggctgttaaccttctgcctataatagaaacgcccaaagccccagaacccagacgacagtacaccctagaagactggcaagagataaaaaagatagaccagttctctgagactccggaggggacctgctatacctcatatgggaaggaaatcctgccccacaaagaagggttagaatatgtccaacagatacatcgtctcacccacctaggaactaaacacctgcagcagttggtcagaacatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaaaaaaatactggaggaaatttttccgagatttggaatacctaaggtaatcgggtcagacaatggtccagcttttgttgcccaggtaagtcagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccctatgaattgctctacgggggaccccccccgttggtagaaattgcttctgtacatagtgctgatgtgctgctttcccagcctttgttctctaggctcaaggcgctcgagtgggtgaggcaacgagcgtggaagcagctccgggaggcctactcaggagaaggagacttgcaagttccacatcgcttccaagtgggagattcagtctatgttagacgccaccgtgcaggaaacctcgagactcggtggaagggcccttatctcgtacttttgaccacaccaacggctgtgaaagtcgaaggaatctccacctggatccatgcatcccacgttaagctggcgccacctcccgactcggggtggagagccgaaaagactgagaatccccttaagcttcgcctccatcgcctggttccttactctaacaataactccccaggccagtagtaaacgccttatagacagctcgaacccccatagacctttatcccttacctggctgattattgaccctgatacgggtgtcactgtaaatagcactcgaggtgttgctcctagaggcacctggtggcctgaactgcatttctgcctccgattgattaaccccgctgttaaaagcacacctcccaacctagtccgtagttatgggttctattgctgcccaggcacagagaaagagaaatactgtgggggttctggggaatccttctgtaggagatggagctgcgtcacctccaacgatggagactggaaatggccgatctctctccaggaccgggtaaaattctcctttgtcaattccggcccgggcaagtacaaagtgatgaaactatataaagataagagctgctccccatcagacttagattatctaaagataagtttcactgaaaaaggaaaacaggaaaatattcaaaagtggataaatggtatgagctggggaatagttttttataaatatggcgggggagcagggtccactttaaccattcgccttaggatagagacggggacagaaccccctgtggcagtgggacccgataaagtactggctgaacaggggccccctggagccaccgcataacttgccggtgccccaattaacctcgctgcggcctgacataacacagccgcctagcaacggtaccactggattgattcctaccaacacgcctagaaactccccaggtgttcctgttaagacaggacagagactcttcagtctcatccagggagctttccaagccatcaactccaccgaccctgatgccacttcttcttgttggctttgtctatcctcagggcctccttattatgaggggatggctaaagaaggaaaattcaatgtgaccaagagcatagaaatcaatgtacatgggggtcccgaaataagcttaccctcactgaagtttccgggaaggggacatgcataggaaaagctcccccatcccaccaacacctttgctatagtactgtggtttatgagcaggcctcagaaaatcagtatttagtacctggttataacaggtggtgggcatgcaatactgggttaaccccctgtgtttccacctcagtcttcaaccaatccaaagatttctgtgtcatggtccaaatcgtcccccgagtgtactaccatcctgaggaagtggtccttgatgaatatgactatcggtataaccgaccaaaaagagaacccgtatcccttaccctagctgtaatgctcggattagggacggccgttggcgtaggaacagggacagctgccctgatcacaggaccacagcagctagagaaaggacttggtgagctacatgcggccatgacagaagatctccgagccttagaggagtctgttagcaacctagaagagtccctgacttctttgtctgaagtggttctacagaaccggaggggattagatctgctgtttctaagagaaggtgggttatgtgcagccttaaaagaagaatgttgcttctatgtagatcactcaggagccatcagagactccatgagcaagcttagagaaaggttagagaggcgtcgaagggaaagagaggctgaccaggggtggtttgaaggatggttcaacaggtctccttggatgaccaccctgctttctgctctgacgggacccctagtagtcctgctcctgttacttacagttgggccttgcttaattaataggtttgttgcctttgttagagaacgagtgagtgcagtccagatcatggtacttaggcaacagtaccaaggccttctgagccaaggagaaactgacctctagccttcccagttctaagattagaactattaacaagacaagaagtggggaatgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgaaagccctagtgacgtatctcaactgcaatctgtcactctgcccaggagcccgtgcagatgcggacctccggagctattttaaaatgattggtccacggagcgcgggctctcgatattttaaaatgattggtccacggagcgcgggctctcgatattttaaaatgattggtttgtgacgcacaggctttgttgtgaaccccataaaagctgtcccgattccgcactcggggccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgagggggattgttcttttactggcctttcaccagtcctttcttttcttttctgcctcagcatgtcatccaccggcggaccggatactttgtttatcttgaaactgtgtgttaacatttagcacaacatttaaaggacagttggaatctaaaacaaaattccaacaaagaaagcaaaacacagaggaagtaaaaactcttgcaacttctgtttttcaacaatacttctgagttccctgggggcacagcaagttatggatccacggtgtcactgcagaggctcgggtcaccgcgtgacgcagatttgacctctggcctgggaacttccacgtggaaagaaaagcttcctgtgattgtttccgtgtttcttttctcccacacctggacgctgatggcttcctggaacccacttagaaaagcaatttccatatccttctttgtagatgagtaaatccttctaaaaatcacttggtcctatttaggcaccggccgctttcccattttatacagaaagaagccgaagagtccagca

SEQ ID NO: 267 - DNA, 14475 bp, artificial
  115418811_C sequence
tgaaaggatgaaaatacaacctaagctaatgagaagcttaaaattgttctgaattccagagtttgttccttataggtaaaagattaggttttttgctgttttaaaatatgcggaagtaaaataggccctgagtacatgtctctaggcatgaaacttcttgaaactatttgagataacaagaaaagggagtttctaactgcttgtttagcttctgtaaaactggttgcgccataaagatgttgaaatgttgatacacatatcttggtgacaacatgtctcccccaccccgaaacatgcgcaaatgtgtaactctaaaacaatttaaattaattggtccacgaagcgcgggctctcgaagttttaaattgactggtttgtgatattttgaaatgattggtttgtaaagcgcgggctttgttgtgaaccccataaaagctgtcccgactccacactcggggccgcagtcctctacccctgcgtggtgtacgactgtgggccccagcgcgcttggaataaaaatcctcttgctgtttgcatcaagaccgcttctcgtgagtgattaaggggagtcgccttttccgagcctggaggttctttttgctggtcttacatttgggggctcgtccgggatctgtcgcggccacccctaacacccgagaaccgacttggaggtaaaaaggatcctctttttaacgtgtatgcatgtaccggccggcgtctctgttctgagtgtctgttttcagtggtgcgcgctttcggtttgcagctgtcctctcaggccgtaagggctgggggactgtgatcagcagacgtgctaggaggatcacaggctgctgccctgggggacgccccgggaggtgaggagagccagggacgcctggtggtctcctactgtcggtcagaggaccgaattctgttgctgaagcgaaagcttccccctccgcgaccgtccgactcttttgcctgcttgtggaagacgtggacgggtcacgtgtgtctggatctgttggtttctgttttgtgtgtctttgtcttgtgtgtccttgtctacagttttaatatgggacagacggtgacgacccctcttagtttgactctcgaccattggactgaagttaaatccagggctcataatttgtcagttcaggttaagaagggaccttggcagactttctgtgtctctgaatggccgacattcgatgttggatggccatcagaggggacctttaattctgagattatcctggctgttaaagcaattatttttcagactggacccggctctcatcccgatcaggagccctatatccttacgtggcaagatttggcagaggatcctccgccatgggttaaaccatggctgaataagccaagaaagccaggtccccgaattctggctcttggagagaaaaacaaacactcggctgaaaaagtcaagccctctcctcatatctaccccgagattgaggagccaccggcttggccggaaccccaatctgttcccccacccccttatctggcacagggtgccgcgaggggaccctttgcccctcctggagctccggcggtggagggacctgctgcagggactcggagccggaggggcgccaccccggagcggacagacgagatcgcgacattaccgctgcgcacgtacggccctcccacaccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctattagaggctagaaaaaatgttcctggggccgacgggcgacccacgcggttgcaaaatgagattgacatgggatttcccttaactcgccccggttgggactacaacacggctgaaggtagggagagcttgaaaatctatcgccaggctctggtggcgggtctccggggcgcctcaagacggcccactaatttggctaaggtaagagaagtgatgcagggaccgaatgaacccccctctgtttttcttgagaggctcttggaagccttcaggcggtacaccccttttgatcccacctcagaggcccaaaaagcctcagtggctttggcctttataggacagtcagccttggatattagaaagaagcttcagagactggaagggttacaggaggctgagttacgtgatctagtgaaggaggcagagaaagtatattacaaaagggagacagaagaagaaagggaacaaagaaaagagagagaaagagaggaaagggaggaaagacgtaataaacggcaagagaagaatttgactaagatcttggctgcagtggttgaagggaaaagcaatacggaaagagagagagattttaggaaaattaggtcaggccctagacagtcagggaacctgggcaataggaccccactcgacaaggaccaatgtgcatattgtaaagaaagaggacactgggcaaggaactgccccaagaagggaaacaaaggaccaaggatcctagctctagaagaagataaagattaggggagacggggttcggaccccctccccgagcccagggtaactttgaaggtggaggggcaaccagttgagttcctggttgataccggagcgaaacattcagtgctactacagccattaggaaaactaaaagataaaaaatcctgggtgatgggtgccacagggcaacaacagtatccatggactacccgaagaacagttgacttgggagtgggacgggtaacccactcgtttctggtcatacctgagtgcccagcacccctcttaggtagagacttattgaccaagatgggagcacaaatttcttttgaacaagggaaaccagaagtgtctgcaaataacaaacctatcactgtgttgaccctccaattagatgacgaatatcgactatactctcccctagtaaagcctgatcaaaatatacaattctggttggaacagtttccccaagcctgggcagaaaccgcagggatgggtttggcaaagcaagttcccccacaagttattcaactgaaggccagtgccacaccagtgtcagtcagacagtaccccttgagtaaagaagctcaagaaggaattcggccgcatgtccaaagattaatccaacagggcatcctagttcctgtccaatctccctggaatactcccctgctaccggttagaaagcctgggactaatgactatcgaccagtacaggacttgagagaggtcaataaacgggtgcaggatatacacccaacagtcccgaacccttataacctcttgtgtgctctcccaccccaacggagctggtatacagtattggacttaaaggatgccttcttctgcctgagattacaccccactagccaaccactttttgccttcgaatggagagatccaggtacgggaagaaccgggcagctcacctggacccgactgccccaagggttcaagaactccccgaccatctttgacgaagccctacacagagacctggccaacttcaggatccaacaccctcaggtgaccctcctccagtacgtggatgacctgcttctggcgggagccaccaaacaggactgcttagaaggcacgaaggcactactgctggaattgtctgacctaggctacagagcctctgctaagaaggcccagatttgcaggagagaggtaacatacttggggtacagtttgcgggacgggcagcgatggctgacggaggcacggaagaaaactgtagtccagataccggccccaaccacagccaaacaaatgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccggggagttttaacccaaaccctaggaccatggagaagacctgtcgcctacctgtcaaagaagctcgatcctgtagccagtggttggcccatatgcctgaaggctatcgcagctgtggccatactggtcaaggacgctgacaaattgactttgggacagaatataactgtaatagccccccatgcattggagaacatcgttcggcagcccccagaccgatggatgaccaacgcccgcatgacccactatcaaagcctgcttctcacagagagggtcacgttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaggatggctggggcggcggtggtggacgggacccgcacgatctgggccagcagcctgccggaaggaacttcagcacaaaaggctgagctcatggccctcacgcaagctttgcggctggccgaagggaaatccataaacatttatacggacagcaggtatgcctttgcgactgcacacgtacatggggccatctataaacaaagggggttgcttacctcagcagggagggaaataaagaacaaagaggaaattctaagcctattagaagccgtacatttaccaaaaaggctagctattatacactgtcctggacatcagaaagctaaagatctcatatccagaggaaaccagatggctgaccgggttgccaagcaggcagcccagggtgttaaccttctgcctataatagaaatgcccaaagccccagaacccagacgacagtacaccctagaagactggcaagagataaaaaagatagaccagttctctgagactccggaagggacctgctatacctcagatgggaaggaaatcctgccccacaaagaagggttagaatatgtccaacagatacatcgtctaacccacctaggaactaaacacctgcagcagttggtcagaacatccccttatcatgttctgaggctaccaggagtggctgactcggtggtcaaacattgtgtgccctgccagctggttaatgctaatccttccagaatgcctccagggaagagactaaggggaagccacccaggcgctcactgggaagtggacttcactgaggtaaagccggctaaatacggaaacaaatacctattggtttttgtagacaccttttcaggatgggtagaggcttatcctactaagaaagagacttcaaccgtggtggctaaaaaaatactggaagaaatttttccaagatttggaatacctaaggtaatagggtcagacaatggtccagcttttgttgcccaggtaagtcagggactggccaagatattggggattgattggaaactgcattgtgcatacagaccccaaagctcaggacaggtagagaggatgaatagaaccattaaagagacccttactaaattgaccgcggagactggcgttaatgattggatagctctcctgccctttgtgctttttagggttaggaacacccctggacagtttgggctgaccccctatgaattactctacgggggaccccccccattggtagaaattgcttctgtacatagtgctgacgtgctgctttcccagcctttgttctctaggctcaaggcacttgagtgggtgagacaacgagcgtggaggcaactccgggaggcctactcaggaggaggagacttgcagatcccacatcgtttccaagtgggagattcagtctacgttagacgccaccgtgcaggaaacctcgagactcggtggaagggcccttatctcgtacttttgaccacaccaacggctgtgaaagtcgaaggaatctccacctggatccatgcatcccacgttaaaccggcgccacctcccgattcggggtggaaagccgaaaagactgaaaatccccttaagcttcgcctccatcgcgtggttccttactctgtcaataacctctcagactaatggtatgcgcataggagacagcctgaactcccataaacccttatctctcacctggttaattactgactccggcacaggtattaatatcaacaacactcaaggggaggctcctttaggaacctggtggcctgatctatacgtttgcctcagatcagttattcctagtctgacctcacccccagatatcctccatgctcacggattttatgtttgcccaggaccaccaaataatggaaaacattgcggaaatcccagagatttcttttgtaaacaatggaactgtgtaacctctaatgatggatattggaaatggccaacctctcagcaggatagggtaagtttttcttatgtcaacacctataccagctctggacaatttaattacctgacctggattagaactggaagccccaagtgctctccttcagacctagattacctaaaaataagtttcactgagaaaggaaaacaagaaaatatcctaaaatgggtaaatggtatgtcttggggaatggtatattatggaggctcgggtaaacaaccaggctccattctaactattcgcctcaaaataaaccagctggagcctccaatggctataggaccaaatacggtcttgacgggtcaaagacccccaacccaaggaccaggaccatcctctaacataacttctggatcagaccccactgagtctaacagcacgactaaaatgggggcaaaactttttagcctcatccagggagcttttcaagctcttaactccacgactccagaggctacctcttcttgttggctatgcttagcttcgggcccaccttactatgaaggaatggctagaagagggaaattcaatgtgacaaaagaacatagagaccaatgcacatggggatcccaaaataagcttacccttactgaggtttctggaaaaggcacctgcataggaaaggttcccccatcccaccaacacctttgtaaccacactgaagcctttaatcaaacctctgagagtcaatatctggtacctggttatgacaggtggtgggcatgtaatactggattaaccccttgtgtttccaccttggtttttaaccaaactaaagatttttgcattatggtccaaattgttccccgagtgtattactatcccgaaaaagcaatccttgatgaatatgactacagaaatcatcgacaaaagagagaacccatatctctgacacttgctgtgatgctcggacttggagtggcagcaggtgtaggaacaggaacagctgccctggtcacgggaccacagcagctagaaacaggacttagtaacctacatcgaattgtaacagaagatcgatccccaacgcctcacggggttggtggagtcccttatgttctctcaccagcctacttgggatgattgtcaacagctgctgcagacactcttcacaaccgaggagcgagagagaattctattagaggctagaaaaaatgttcctggggccgacgggcgacccacgcggttgcaaaatgagattgacatgggatttcccttaactcgccccggttgggactacaacacggctgaaggtagggagagcttgaaaatctatcgccaggctctggtggcgggtctccggggcgcctcaagacggcccactaatttggctaaggtaagagaagtgatgcagggaccgaatgaacccccctctgtttttcttgagaggctcttggaagccttcaggcggtacaccccttttgatcccacctcagaggcccaaaaagcctcagtggctttggcctttataggacagtcagccttggatattagaaagaagcttcagagactggaagggttacaggaggctgagttacgtgatctagtgaaggaggcagagaaagtatattacaaaagggagacagaagaagaaagggaacaaagaaaagagagagaaagagaggaaagggaggaaagacgtaataaacggcaagagaaaaatttgactaagatcttggctgcagtggttgaagggaaaagcaatacggaaagagagagagattttaggaaaattaggtcaggccctagacagtcagggaacctgggcaataggaccccactcgacaaggaccaatgtgcatattgtaaagaaagaggacactgggcaaggaactgccccaagaagggaaacaaaggaccaaggatcctagctctagaagaagataaagattaggggagacggggttcggaccccctccccgagcccagggtaactttgaaggtggaggggcaaccagttgagttcctggttgataccggagcgaaacattcagtgctactacagccattaggaaaactaaaagataaaaaatcctgggtgatgggtgccacagggcaacaacagtatccatggactacccgaagaacagttgacttgggagtgggacgggtaacccactcgtttctggtcatacctgagtgcccagcacccctcttaggtagagacttattgaccaagatgggagcacaaatttcttttgaacaagggaaaccagaagtgtctgcaaataacaaacctatcactgtgttgaccctccaattagatgacgaatatcgactatactctcccctagtaaagcctgatcaaaatatacaattctggttggaacagtttccccaagcctgggcagaaaccgcagggatgggtttggcaaagcaagttcccccacaagttattcaactgaaggccagtgccacaccagtgtcagtcagacagtaccccttgagtaaagaagctcaagaaggaattcggccgcatgtccaaagattaatccaacagggcatcctagttcctgtccaatctccctggaatactcccctgctaccggttagaaagcctgggactaatgactatcgaccagtacaggacttgagagaggtcaataaacgggtgcaggatatacacccaacagtcccgaacccttataacctcttgtgtgctctcccaccccaacggagctggtatacagtattggacttaaaggatgccttcttctgcctgagattacaccccactagccaaccactttttgccttcgaatggagagatccaggtacgggaagaaccgggcagctcacctggacccgactgccccaagggttcaagaactccccgaccatctttgacgaagccctacacagagacctggccaacttcaggatccaacaccctcaggtgaccctcctccagtacgtggatgacctgcttctggcgggagccaccaaacaggactgcttagaaggcacgaaggcactactgctggaattgtctgacctaggctacagagcctctgctaagaaggcccagatttgcaggagagaggtaacatacttggggtacagtttgcgggacgggcagcgatggctgacggaggcacggaagaaaactgtagtccagataccggccccaaccacagccaaacaaatgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccggggagttttaacccaaaccctaggaccatggagaagacctgtcgcctacctgtcaaagaagctcgatcctgtagccagtggttggcccatatgcctgaaggctatcgcagctgtggccatactggtcaaggacgctgacaaattgactttgggacagaatataactgtaatagccccccatgcattggagaacatcgttcggcagcccccagaccgatggatgaccaacgcccgcatgacccactatcaaagcctgcttctcacagagagggtcacgttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaggatggctggggcggcggtggtggacgggacccgcacgatctgggccagcagcctgccggaaggaacttcagcacaaaaggctgagctcatggccctcacgcaagctttgcggctggccgaagggaaatccataaacatttatacggacagcaggtatgcctttgcgactgcacacgtacatggggccatctataaacaaagggggttgcttacctcagcagggagggaaataaagaacaaagagaaaattctaagcctattagaagccgtacatttaccaaaaaggctagctattatacactgtcctggacatcagaaagctaaagatctcatatccagaggaaaccagatggctgaccgggttgccaagcaggcagcccagggtgttaaccttctgcctataatagaaatgcccaaagccccagaacccagacgacagtacaccctagaagactggcaagagataaaaaagatagaccagttctctgagactccggaagggacctgctatacctcagatgggaaggaaatcctgccccacaaagaagggttagaatatgtccaacagatacatcgtctaacccacctaggaactaaacacctgcagcagttggtcagaacatccccttatcatgttctgaggctaccaggagtggctgactcggtggtcaaacattgtgtgccctgccagctggttaatgctaatccttccagaatgcctccagggaagagactaaggggaagccacccaggcgctcactgggaagtggacttcactgaggtaaagccggctaaatacggaaacaaatacctattggtttttgtagacaccttttcaggatgggtagaggcttatcctactaagaaagagacttcaaccgtggtggctaaaaaaaatactggaagaaatttttccaagatttggaatacctaaggtaatagggtcagacaatggtccagcttttgttgcccaggtaagtcagggactggccaagatattggggattgattggaaactgcattgtgcatacagaccccaaagctcaggacaggtagagaggatgaatagaaccattaaagagacccttactaaattgaccgcggagactggcgttaatgattggatagctctcctgccctttgtgctttttagggttaggaacacccctggacagtttgggctgaccccctatgaattactctacgggggaccccccccattggtagaaattgcttctgtacatagtgctgacgtgctgctttcccagcctttgttctctaggctcaaggcacttgagtgggtgagacaacgagcgtggaggcaactccgggaggcctactcaggaggaggagacttgcagatcccacatcgtttccaagtgggagattcagtctacgttagacgccaccgtgcaggaaacctcgagactcggtggaagggcccttatctcgtacttttgaccacaccaacggctgtgaaagtcgaaggaatctccacctggatccatgcatcccacgttaaaccggcgccacctcccgattcggggtggaaagccgaaaagactgaaaatccccttaagcttcgcctccatcgcgtggttccttactctgtcaataacctctcagactaatggtatgcgcataggagacagcctgaactcccataaacccttatctctcacctggttaattactgactccggcacaggtattaatatcaacaacactcaaggggaggctcctttaggaacctggtggcctgatctatacgtttgcctcagatcagttattcctagtctgacctcacccccagatatcctccatgctcacggattttatgtttgcccaggaccaccaaataatggaaaacattgcggaaatcccagagatttcttttgtaaacaatggaactgtgtaacctctaatgatggatattggaaatggccaacctctcagcaggatagggtaagtttttcttatgtcaacacctataccagctctggacaatttaattacctgacctggattagaactggaagccccaagtgctctccttcagacctagattacctaaaaataagtttcactgagaaaggaaaacaagaaaatatcctaaaatgggtaaatggtatgtcttggggaatggtatattatggaggctcgggtaaacaaccaggctccattctaactattcgcctcaaaataaaccagctggagcctccaatggctataggaccaaatacggtcttgacgggtcaaagacccccaacccaaggaccaggaccatcctctaacataacttctggatcagaccccactgagtctaacagcacgactaaaatgggggcaaaactttttagcctcatccagggagcttttcaagctcttaactccacgactccagaggctacctcttcttgttggctatgcttggcttcgggcccaccttactatgaaggaatggctagaagagggaaattcaatgtgacaaaagaacatagagaccaatgcacatggggatcccaaaataagcttacccttactgaggtttctggaaaaggcacctgcataggaaaggttcccccatcccaccaacacctttgtaaccacactgaagcctttaatcaaacctctgagagtcaatatctggtacctggttatgacaggtggtgggcatgtaatactggattaaccccttgtgtttccaccttggtttttaaccaaactaaagatttttgcattatggtccaaattgttccccgagtgtattactatcccgaaaaagcaatccttgataaatatgactacagaaatcatcgacaaaagagagaacccatatctctgacacttgctgtgatgctcggacttggagtggcagcaggtgtaggaacaggaacagctgccctggtcacgggaccacagcagctagaaacaggacttagtaacctacatcgaattgtaacagaagatctccaagccctagaaaaatctgtcagtaacctggaggaatccctaacctccttatctgaagtagtcctacagaatagaagagggttagatttattatttctaaaagaaggaggattatgtgtagccttgaaggaggaatgctgtttttatgtggatcattcaggggccatcagagactccatgaacaagcttagagaaaggttggagaagcgtcgaagggaaaaggaaactactcaagggtggtttgagggatggttcaacaggtctccttggttggctaccctactttctgctttaacaggacccttaatagtcctcctcctgttactcacagttgggccatgtattattaacaagttcaattgccttcattagagaacgaataagtgcagtccagatcatggtacttagacaacagtaccaaagcccgtctagcagggaagctggccgctagctctaccagttctaagattagaactattaacaagagaagaagtggggaatgaaaggatgaaaatacaacctaagctaatgagaagcttaaaattgttctgaattccagagtttgttccttataggtaaaagattaggttttttgctgttttaaaatatgcggaagtaaaataggccctgagtacatgtctctaggcatgaaacttcttgaaactatttgagataacaagaaaagggagtttctaactgcttgtttagcttctgtaaaactggttgcgccataaagatgttgaaatgttgatacacatatcttggtgacaacatgtctcccccaccccgaaacatgcgcaaatgtgtaactctaaaacaatttaaattaattggtccacgaagcgcgggctctcgaagttttaaattgactggtttgtgatattttgaaatgattggtttgtaaagcgcgggctttgttgtgaaccccataaaagctgtcccgactccacactcggggccgcagtcctctacccctgcgtggtgtacgactgtgggccccagcgcgcttggaataaaaatcctcttgctgtttgcatcaagaccgcttctcgtgagtgattaaggggagtcgccttttccgagcctggaggttctttttgctggtcttaca

SEQ ID NO: 268 - DNA, 8886 bp, artificial
  338173793_C sequence
aacgccagatccttaacccactgagcgaggccatagatcgaacctgaaacctcatggttcctagtcagatttgtttccactgcaccacaacagggaactccaagtttgtgtttttaatctctatgctgtacctttttttttttttaattgtaggaaatagtcttgtgtatagtttaaggaagtctgtttgctattaggtttgtgaggtggtttgaaaggatgaaaatacaacctaagctaatgagaagcttaaaattgttctgaattccagagtttgttccttataggtaaaagattaggttttttgctgttttaaaatatgcggaagtaaaataggccctgagtacatgtctctaggcatgaaacttcttgaaactatttgagataacaagaaaagggagtttctaactgcttgtttagcttctgtaaaactggttgcgccataaagatgttgaaatgttgatacacatatcttggtgacaacatgtctcccccaccccgaaacatgcgcaaatgtgtaactctaaaacaatttaaattaattggtccacgaagcgcgggctctcgaagttttaaattgactggtttgtgatattttgaaatgattggtttgtaaagcgcgggctttgttgtgaaccccataaaagctgtcccgactccacactcggggccgcagtcctctacccctgcgtggtgtacgactgtgggccccagcgcgcttggaataaaaatcctcttgctgtttgcatcaagaccgcttctcgtgagtgattaaggggagtcgccttttccgagcctggaggttctttttgctggtcttacatttgggggctcgtccgggatctgtcgcggccacccctaacacccgagaaccgacttggaggtaaaaaggatcctctttttaacgtgtatgcatgtaccggccggcgtctctgttctgagtgtctgttttcagtggtgcgcgctttcggtttgcagctgtcctctcaggccgtaagggctgggggactgtgatcagcagacgtgctaggaggatcacaggctgctgccctgggggacgccccgggaggtgaggagagccagggacgcctggtggtctcctactgtcggtcagaggaccgaattctgttgctgaagcgaaagcttccccctccgcgaccgtccgactcttttgcctgcttgtggaagacgtggacgggtcacgtgtgtctggatctgttggtttctgttttgtgtgtctttgtcttgtgtgtccttgtctacagttttaatatgggacagacggtgacgacccctcttagtttgactctcgaccattggactgaagttaaatccagggctcataatttgtcagttcaggttaagaagggaccttggcagactttctgtgtctctgaatggccgacattcgatgttggatggccatcagaggggacctttaattctgagattatcctggctgttaaagcaattatttttcagactggacccggctctcatcccgatcaggagccctatatccttacgtggcaagatttggcagaggatcctccgccatgggttaaaccatggctgaataagccaagaaagccaggtccccgaattctggctcttggagagaaaaacaaacactcggctgaaaaagtcaagccctctcctcatatctaccccgagattgaggagccaccggcttggccggaaccccaatctgttcccccacccccttatctggcacagggtgccgcgaggggaccctttgcccctcctggagctccggcggtggagggacctgctgcagggactcggagccggaggggcgccaccccggagcggacagacgagatcgcgacattaccgctgcgcacgtacggccctcccacaccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctattagaggctagaaaaaatgttcctggggccgacgggcgacccacgcggttgcaaaatgagattgacatgggatttcccttaactcgccccggttgggactacaacacggctgaaggtagggagagcttgaaaatctatcgccaggctctggtggcgggtctccggggcgcctcaagacggcccactaatttggctaaggtaagagaagtgatgcagggaccgaatgaacccccctctgtttttcttgagaggctcttggaagccttcaggcggtacaccccttttgatcccacctcagaggcccaaaaagcctcagtggctttggcctttataggacagtcagccttggatattagaaagaagcttcagagactggaagggttacaggaggctgagttacgtgatctagtgaaggaggcagagaaagtatattacaaaagggagacagaagaagaaagggaacaaagaaaagagagagaaagagaggaaagggaggaaagacgtaataaacggcaagagaagaatttgactaagatcttggctgcagtggttgaagggaaaagcaatacggaaagagagagagattttaggaaaattaggtcaggccctagacagtcagggaacctgggcaataggaccccactcgacaaggaccaatgtgcatattgtaaagaaagaggacactgggcaaggaactgccccaagaagggaaacaaaggaccaaggatcctagctctagaagaagataaagattaggggagacggggttcggaccccctccccgagcccagggtaactttgaaggtggaggggcaaccagttgagttcctggttgataccggagcgaaacattcagtgctactacagccattaggaaaactaaaagataaaaaatcctgggtgatgggtgccacagggcaacaacagtattcatggactacccgaagaacagttgacttgggagtgggacgggtaacccactcgtttctggtcatacctgagtgcccagcacccctcttaggtagagacttattgaccaagatgggagcacaaatttcttttgaacaagggaaaccagaagtgtctgcaaataacaaacctatcactgtgttgaccctccaattagatgacgaatatcgactatactctcccctagtaaagcctgatcaaaatatacaattctggttggaacagtttccccaagcctgggcagaaaccgcagggatgggtttggcaaagcaagttcccccacaagttattcaactgaaggccagtgccacaccagtgtcagtcagacagtaccccttgagtaaagaagctcaagaaggaattcggccgcatgtccaaagattaatccaacagggcatcctagttcctgtccaatctccctggaatactcccctgctaccggttagaaagcctgggactaatgactatcgaccagtacaggacttgagagaggtcaataaacgggtgcaggatatacacccaacagtcccgaacccttataacctcttgtgtgctctcccaccccaacggagctggtatacagtattggacttaaaggatgcctttttctgcctgagattacaccccactagccaaccactttttgccttcgaatggagagatccaggtacgggaagaaccgggcagctcacctggacccgactgccccaagggttcaagaactccccgaccatctttgacgaagccctacacagagacctggccaacttcaggatccaacaccctcaggtgaccctcctccagtacgtggatgacctgcttctggcgggagccaccaaacaggactgcttagaaggcacgaaggcactactgctggaattgtctgacctaggctacagagcctctgctaagaaggcccagatttgcaggagagaggtaacatacttggggtacagtttgcgggacgggcagcgatggctgacggaggcacggaagaaaactgtagtccagataccggccccaaccacagccaaacaaatgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccggggagttttaacccaaaccctaggaccatggagaagacctgtcgcctacctgtcaaagaagctcgatcctgtagccagtggttggcccatatgcctgaaggctatcgcagctgtggccatactggtcaaggacgctgacaaattgactttgggacagaatataactgtaatagccccccatgcattggagaacatcgttcggcagcccccagaccgatggatgaccaacgcccgcatgacccactatcaaagcctgcttctcacagagagggtcacgttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaggatggctggggcggcggtggtggacgggacccgcacgatctgggccagcagcctgccggaaggaacttcagcacaaaaggctgagctcatggccctcacgcaagctttgcggctggccgaagggaaatccataaacatttatacggacagcaggtatgcctttgcgactgcacacgtacatggggccatctataaacaaagggggttgcttacctcagcagggagggaaataaagaacaaagaggaaattctaagcctattagaagccgtacatttaccgaaaaggctagctattatacactgtcctggacatcagaaagctaaagatctcatatccagaggaaaccagatggctgaccgggttgccaagcaggcagcccagggtgttaaccttctgcctataatagaaatgcccaaagccccagaacccagacgacagtacaccctagaagactggcaagagataaaaaagatagaccagttctctgagactccggaagggacctgctatacctcagatgggaaggaaatcctgccccacaaagaagggttagaatatgtccaacagatacatcgtctaacccacctaggaactaaacacctgcagcagttggtcagaacatccccttatcatgttctgaggctaccaggagtggctgactcggtggtcaaacattgtgtgccctgccagctggttaatgctaatccttccagaatgcctccagggaagagactaaggggaagccacccaggcgctcactgggaagtggacttcactgaggtaaagccggctaaatacggaaacaaatacctattggtttttgtagacaccttttcaggatgggtagaggcttatcctactaagaaagagacttcaaccgtggtggctaaaaaaatactggaagaaatttttccaagatttggaatacctaaggtaatagggtcagacaatggtccagcttttgttgcccaggtaagtcagggactggccaagatattggggattgattggaaactgcattgtgcatacagaccccaaagctcaggacaggtagagaggatgaatagaaccattaaagagacccttactaaattgaccgcggagactggcgttaatgattggatagctctcctgccctttgtgctttttagggttaggaacacccctggacagtttgggctgaccccctatgaattactctacgggggaccccccccattggtagaaattgcttctgtacatagtgctgacgtgctgctttcccagcctttgttctctaggctcaaggcacttgagtgggtgagacaacgagcgtggaggcaactccgggaggcctactcaggaggaggagacttgcagatcccacatcgtttccaagtgggagattcagtctacgttagacgccaccgtgcaggaaacctcgagactcggtggaagggcccttatcacgtacttttgaccacaccaacggctgtgaaagtcgaaggaatctccacctggatccatgcatcccacgttaagccggcgccacctcccgattcggggtggaaagccgaaaagactgaaaatccccttaagcttcgcctccatcgcgtggttccttactctgtcaataacctctcagactaatggtatgcgcataggagacagcctgaactcccataaacccttatctctcacctggttaattactgactccggcacaggtattaatatcaacaacactcaaggggaggctcctttaggaacctggtggcctgatctatacgtttgcctcagatcagttattcctagtctgacctcacccccagatatcctccatgctcacggattttatgtttgcccaggaccaccaaataatggaaaacattgcggaaatcccagagatttcttttgtaaacaatggaactgtgtaacctctaatgatggatattggaaatggccaacctctcagcaggatagggtaagtttttcttatgtcaacacctataccagctctggacaatttaattacctgacctggattagaactggaagccccaagtgctctccttcagacctagattacctaaaaataagtttcactgagaaaggaaaacaagaaaatatcctaaaatgggtaaatggtatgtcttggggaatggtatattatggaggctcgggtaaacaaccaggctccattctaactattcgcctcaaaataaaccagctggagcctccaatggctataggaccaaatacggtcttgacgggtcaaagacccccaacccaaggaccaggaccatcctctaacataacttctggatcagaccccactgagtctaacagcacgactaaaatgggggcaaaactttttagcctcatccagggagcttttcaagctcttaactccacgactccagaggctacctcttcttgttggctatgcttagctttgggcccaccttactatgaaggaatggctagaagagggaaattcaatgtgacaaaagaacatagagaccaatgcacatggggatcccaaaataagcttacccttactgaggtttctggaaaaggcacctgcataggaaaggttcccccatcccaccaacacctttgtaaccacactgaagcctttaatcaaacctctgagagtcaatatctggtacctggttatgacaggtggtgggcatgtaatactggattaaccccttgtgtttccactttggtttttaaccaaactaaagatttttgcattatggtccaaattgttccccgagtgtattactatcccgaaaaagcaatccttgatgaatatgactacagaaatcatcgacaaaagagagaacccatatctctgacacttgctgtgatgctcggacttggagtggcagcaggtgtaggaacaggaacagctgccctggtcacgggaccacagcagctagaaacaggacttagtaacctacatcgaattgtaacagaagatctccaagccctagaaaaatctgtcagtaacctggaggaatccctaacctccttatctgaagtagtcctacagaatagaagagggttagatttattatttctaaaagaaggaggattatgtgtagccttgaaggaggaatgctgtttttatgtggatcattcaggggccatcagagactccatgaacaagcttagagaaaggttggagaagcgtcgaagggaaaaggaaactactcaagggtggtttgagggatggttcaacaggtctccttggttggctaccctactttctgctttaacaggacccttaatagtcctcctcctgttactcacagttgggccatgtattattaacaagttaattgccttcattagagaacgaataagtgcagtccagatcatggtacttagacaacagtaccaaagcccgtctagcagggaagctggccgctagctctaccagttctaagattagaactattaacaagagaagaagtggggaatgaaaggatgaaaatacaacctaagctaatgagaagcttaaaattgttctgaattccagagtttgttccttataggtaaaagattaggttttttgctgttttaaaatatgcggaagtaaaataggccctgagtacatgtctctaggcatgaaacttcttgaaactatttgagataacaagaaaagggagtttctaactgcttgtttagcttctgtaaaactggttgcgccataaagatgttgaaatgttgatacacatatcttggtgacaacatgtctcccccaccccgaaacatgcgcaaatgtgtaactctaaaacaatttaaattaattggtccacgaagcgcgggctctcgaagttttaaattgactggtttgtgatattttgaaatgattggtttgtaaagcgcgggctttgttgtgaaccccataaaagctgtcccgactccacactcggggccgcagtcctctacccctgcgtggtgtacgactgtgggccccagcgcgcttggaataaaaatcctcttgctgtttgcatcaagaccgcttctcgtgagtgattaaggggagtcgccttttccgagcctggaggttctttttgctggtcttacatt

SEQ ID NO: 269 - DNA, 9131 bp, artificial
  338173797_C sequence
aatgaaaggatgaaaatacaacctaagctaatgagaagcttaaaattgttctgaattccagagtttgttccttataggtaaaagattaggttttttgctgttttaaaatatgcggaagtaaaataggccctgagtatgtgcctctatgcttgaaacttcttgaaactgctcctaactgcttgtttggcttctgtaaacctgcttgcataagataaaaagaggagaagtcaattgcctaacggaccccagtaagatcgggcgtgccgctcctaactgcttgtttggcttctgtaaacctgcttgcataagataaaaagaggagaagtcaattgcctaacggaccccagtaagatcgggcgtgccgctcctaactgcttgtttggcttctgtaaacctgcttgcataagataaaaagaggagaagtcaattgcctaacggaccccagtaagatcgggcgtgccacaaaatgttgaaatgttgatacacatatcttggtgacaacatgtctcccccaccccgaaacatgcgcaaatgtgtaactctaaaacaatttaaattaattggtccacgaagcgcgggctctcgaagttttaaattgactggtttgtgatattttgaaatgattggtttgtaaagcgcgggctttgttgtgaaccccataaaagctgtcccgactccacactcggggccgcagtcctctacccctgcgtggtgtacgactgtgggccccagcgcgcttggaataaaaatcctcttgctgtttgcatcaagaccgcttctcgtgagtgattaaggggagtcgccttttccgagcctggaggttctttttgctggtcttacatttgggggctcgtccgggatctgtcgcggccacccctaacacccgagaaccgacttggaggtaaaaaggatcctctttttaacgtgtatgcatgtaccggccggcgtctctgttctgagtgtctgttttcagtggtgcgcgctttcggtttgcagctgtcctctcagaccgtaaggactgggggactgtgatcagcagacgtgctaggaggatcacaggctgccaccctgggggacgccccgggaggtggggagagccagggacgcctggtggtctccttctgtcggtcagaggaccgagttctgttgttgaagcgaaagcttccccctccgcggccgtccgactcttttgcctgcttgtggaagacgcggacgggtcgcgtgtgtctggatctgttggtttctgttttgtgtgtctttgtcttgtgcgtccttgtctacagttttaatatgggacagacggtgacgacccctcttagtttgactctcgaccattggactgaagttaaatccagggctcataatttgtcagttcaggttaagaagggaccttggcagactttctgtgtctctgaatggccgacattcgatgttggatggccatcagaggggacctttaattctgagattatcctggctgttaaagcaattatttttcagactggacccggctctcatcccgatcaggagccctatatccttacgtggcaagatttggcagaggatcctccgccatgggttaaaccttggctgaataagccaagaaagccaggtccccgaattctggctcttggagagaaaaacaaacactcggctgaaaaagtcaagccctctcctcatatctaccccgagattgaggagccgccggcttggccggaaccccaatctgttcccccacccccttatccggcacagggtgctgcgaggggaccctctgcccctcctggagctccggcggtggagggacctgctgcagggactcggagccggaggggcgccaccccggagcggacagacgagatcgcgacattaccgctgcgcacgtacggccctcccataccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaacttggctaaggtaagagaagtgatgcagggaccgaatgaacccccctctgtttttcttgagaggctcttggaagccttcaggcggttcaccccttttgatcctacctcggaggctcagaaagcctcagtggctctggccttcataggacagtcagccctggatatcagaaagaagcttcagagactggaagggttacaggaggctgagttacgtgatctagtgaaggaggcagagaaagtgtattacaaaagggagacagaagaagaaagggaacaaagaaaagagagagaaagagaggaaagggaggaaagacgtaataaacggcaagagaagaatttgactaagatcttggctgcagtggttgaagggaaaagcaatacggaaagagagagagattttaggaaaattaggtcaggccctagacagtcagggaacctgggcaataggaccccattcgataaggaccaatgtgcatattgtaaagaaagaggacactgggcaaggaactgccccaagaagggaaacaaaggaccaaggatcctagctctagaagaagataaagattaggggagacggggttcggaccccctccccgagcccagggtaactttgaaggtggaggggcaaccagttgagttcctggttgataccggagcgaaacattcagtgctactacagccattaggaaaactaaaagataaaaaatcctgggtgatgggtgccacagggcaacaacagtattcatggactacccgaagaacagttgacttgggagtgggacgggtaacccactcgtttctggtcatacctgagtgcccagcacccctcttaggtagagacttattgaccaagatgggagcacaaatttcttttgaacaagggaaaccagaagtgtctgcaaataacaaacctatcactgtgttgaccctccaattagatgacgaatatcgactatactctcccctagtaaagcctggtcaaaatatacaattctggttggaacagtttccccaagcctgggcagaaaccgcagggatgggtttggcaaagcaagttcccccacaagttattcaactgaaggccagtgccacaccagtgtcagtcagacagtaccccttgagtaaagaagctcaagaaggaattcggccgcatgtccaaagattaatccaacagggcatcctagttcctgtccaatctccctggaatactcccctgctaccggttagaaagcctgggactaatgactatcgaccagtacaggacttgagagaggtcaataaacgggtgcaggatatacacccaacagtcccgaacccttataacctcttgtgtgctctcccaccccaacggagctggtatacagtattggacttaaaggatgccttcttctgcctgagattacaccccactagccaaccactttttgccttcgaatggagagatccaggtacgggaagaaccgggcagctcacctggacccgactgccccaagggttcaagaactccccgaccatctttgacgaagccctacacagagacctggccaacttcaggatccaacacccccaggtgaccctcctccagtacgtggatgacctgcttctggcgggagccaccaaacaggactgcttagaaggtacgaaggcactactgctggaattgtctgacctaggctacagagcctccgctaagaaggcccagatttgcaggagagaggtaacatacttggggtacagtttgcggggcgggcagcgatggctgacggaggcacggaagagaactgtagtccagataccggccccaaccacagccaaacaagtgagagagtttttggggacagctggattttgcagactgtggatcccggggtttgcgaccttagcagccccactctacccactaaccaaagaaaaaggggaattctcctgggctcctgagcaccagaaggcatttgatgctatcaaaaaggccctgctgagcgcacctgctctggccctccctgacgtgactaaaccctttaccctttatgtggatgagcgtaagggagtagcccggggagttttaacccaaactctaggaccatggaggagacctgttgcctacctgtcaaagaagctcgatcctgtagccagtggttggcccgtatgcctgaaggctatcgcagctgtggccatactggtcaaggacgctgacaaattgactttgggacagaatataactgtaatagccccccatgcgttggagaacatcgttcggcagcccccagaccgatggatgaccaacgcccgcatgacccactatcaaagcctgcttctcacagagagggtcacgttcgctccaccagccgctctcaaccctgccactcttctgcctgaagagactgatgaaccagtgactcatgattgccatcaactattgattgaggagactggggtccgcaaggaccttacagacataccgctgactggagaagtgttaacctggttcactgacggaagcagctatgtggtggaaggtaagaggatggctggggcggcggtggtggacgggacccgcacgatctgggccagcagcctgccggaaggaacttcagcacaaaaggctgagctcatggccctcacgcaagctttgcggctggccgaagggaaatccataaacatttatacagacagcaggtatgcctttgcgactgcacacgtacacggggccatctataagcaaagggggttgcttacctcagcagggagggaaataaagaacaaagaggaaattctaagcctattagaagccgtacatttaccaaaaaggctagctattatacactgtcctggacatcagaaagctaaagatctcatatccagaggaaaccagatggctgaccgggttgccaagcaggcagcccagggtgttaaccttctgcctataatagaaatgcccaaagccccagaacccagacgacagtacaccctagaagactggcaagagataaaaaagatagaccagttctctgagactccggaagggacctgctatacctcagatgggaaggaaatcctgccccacaaagaagggttagaatatgtccaacagatacatcgtctaacccacctaggaactaaacacctgcagcagttggtcagaacatccccttatcatgttctgaggctaccaggagtggctgactcggtggtcaaacattgtgtgccctgccagctgattaatgctaatccttccagaatgcctccagggaagagactaaggggaagccacccaggcgctcactgggaagtggacttcactgaggtaaagccggctaaatacggaaacaaatacctattggtttttgtagacaccttttcaggatgggtagaggcttatcctactaagaaagagacttcaaccgtggtggctaaaaaaatactggaagaaatttttccaagatttggaatacctaaggtaatagggtcagacaatggtccagcttttgttgcccaggtaagtcagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccctatgaattactctacgggggaccccccccattggtagaaattgcttctgtacatagtgctgacgtgctgctttcccagcctttgttctctaggctcaaggcacttgagtgggtgagacaacgagcgtggaggcaactccgggaggcctactcaggaggaggagacttgcagatcccacatcgtttccaagtgggagattcagtctacgttagacgccaccgtgcaggaaacctcgagactcggtggaagggcccttatctcgtacttttgaccacaccaacggctgtgaaagtcgaaggaatctccacctggatccatgcatcccacgttaagccggcgccacctcccgattcggggtggaaagccgaaaagactgaaaatccccttaagcttcgcctccatcgcgtggttccttactctgtcaataacctctcagactaatggtatgcgcataggagacagcctgaactcccataaacccttatctctcacctggttaattactgactccggcacaggtattaatatcaacaacactcaaggggaggctcctttaggaacctggtggcctgatctatacgtttgcctcagatcagttattcctagtctgacctcacccccagatatcctccgtgctcacggattttatgtttgcccaggaccaccaaataatggaaaacattgcggaaatcccagagatttcttttgtaaacaatggaactgtgtaacctctaatgatggatattggaaatggccaacctctcagcaggatagggtaagtttttcttatgtcaacacctataccagctctggacaatttaattacctgacctggattagaactggaagccccaagtgctctccttcagacctagattacctaaaaataagtttcactgagaaaggaaaacaagaaaatatcctaaaatgggtaaatggtatgtcttggggaatggtatattatggaggctcgggtaaacaaccaggctccattctaactattcgcctcaaaataaaccagctggagcctccaatggctataggaccaaatacggtcttgacgggtcaaagacccccaacccaaggaccaggaccatcctctaacataacttctggatcagaccccactgagtctaacagcacgactaaaatgggggcaaaactttttagcctcatccagggagcttttcaagctcttaactccacgactccagaggctacctcttcttgttggctatgcttagctttgggcccaccttactatgaaggaatggctagaagagggaaattcaatgtgacaaaagaacatagagaccaatgcacatggggatcccaaaataagcttacccttactgaggtttctggaaaaggcacctgcataggaaaggttcccccatcccaccaacacctttgtaaccacactgaagcctttaatcaaacctctgagagtcaatatctggtacctggttatgacaggtggtgggcatgtaatactggattaaccccttgtgtttccactttggtttttaaccaaactaaagatttttgcattatggtccaaattgttccccgagtgtattactatcccgaaaaagcaatccttgatgaatatgactacagaaatcatcgacaaaagagagaacccatatctctgacacttgctgtgatgctcggacttggagtggcagcaggtgtaggaacaggaacagctgccctggtcacgggaccacagcagctagaaacaggacttagtaacctacatcgaattgtaacagaagatctccaagccctagaaaaatctgtcagtaacctggaggaatccctaacctccttatctgaagtagtcctacagaatagaagagggttagatttattatttctaaaagaaggaggattatgtgtagccttgaaggaggaatgctgtttttatgtggatcattcaggggccatcagagactccatgaacaagcttagagaaaggttggagaagcgtcgaagggaaaaggaaactactcaagggtggtttgagggatggttcaacaggtctccttggttggctaccctactttctgctttaacaggacccttaatagtcctcctcctgttactcacagttgggccatgtattattaacaagttaattgccttcattagagaacgaataagtgcagtccagatcatggtacttagacaacagtaccaaagcccgtctagcagggaagctggccgctagctctaccagttctaagattagaactattaacaagagaagaagtggggaatgaaaggatgaaaatacaacctaagctaatgagaagcttaaaattgttctgaattccagagtttgttccttataggtaaaagattaggttttttgctgttttaaaatatgcggaagtaaaataggccctgagtatgtgcctctatgcttgaaacttcttgaaactgctcctaactgcttgtttggcttctgtaaacctgcttgcataagataaaaagaggagaagtcaattgcctaacggaccccagtaagatcgggcgtgccgctcctaactgcttgtttggcttctgtaaacctgcttgcataagataaaaagaggagaagtcaattgcctaacggaccccagtaagatcgggcgtgccgctcctaactgcttgtttggcttctgtaaacctgcttgcataagataaaaagaggagaagtcaattgcctaacggaccccagtaagatcgggcgtgccacaaaatgttgaaatgttgatacacatatcttggtgacaacatgtctcccccaccccgaaacatgcgcaaatgtgtaactctaaaacaatttaaattaattggtccacgaagcgcgggctctcgaagttttaaattgactggtttgtgatattttgaaatgattggtttgtaaagcgcgggctttgttgtgaaccccataaaagctgtcccgactccacactcggggccgcagtcctctacccctgcgtggtgtacgactgtgggccccagcgcgcttggaataaaaatcctcttgctgtttgcatcaagaccgcttctcgtgagtgattaaggggagtcgccttttccgagcctggaggttctttttgctggtcttacat

SEQ ID NO: 270 - DNA, 9041 bp, artificial
  338173801_C sequence
  misc_feature (768)..(768): n is a, c, g, or t
  misc_feature (8829)..(8829): n is a, c, g, or t
ataaaaagcctctcttgatccaagcaagattttcttccatttctgcacaattaatcatcttttctttacattaagctcttcaaatcctctcctgtttcaccttcagaattctctccttaatctgctctcaactccatgacttaaccataagatccatggccaagaccaccactgacctcaagttgctaaattcaagtcagtccatggtcctcatctgacttgatcactgaattaggttaaattaatgtttaaattaaataaaggtttgaaaggatgaaaatacaacctaagctaatgagaagcttaaaattgttctgaattccagagtttgttccttataggtaaaagattaggttttttgctgttttaaaatatgcggaagtaaaataggccctgagtacatgtctctaggcatgaaacttcttgaaactatttgagataacaagaaaagggagtttctaactgcttgtttagcttctgtaaaactggttgcgccataaagatgttgaaatgttgatacacatatcttggtgacaacatgtctcccccaccccgaaacatgcgcaaatgtgtaactctaaaacaatttaaattaattggtccacgaagcgcgggctctcgaagttttaaattgactggtttgtgatattttgaaatgattggtttgtaaagcgcgggctttgttgtgaaccccataaaagctgtcccgactccacactcggggccgcagtcctctacccctgcgtggtgtacgactgtgggccccancgcgcttggaataaaaatcctcttgctgtttgcatcaagaccgcttctcgtgagtgattaaggggagtcgccttttccgagcctggaggttctttttgctggtcttacatttgggggctcgtccgggatctgtcgcggccacccctaacacccgagaaccgacttggaggtaaaaaggatcctctttttaacgtgtatgcatgtaccggccggcgtctctgttctgagtgtctgttttcagtggtgcgcgctttcggtttgcagctgtcctctcaggccgtaagggctgggggactgtgatcagcagacgtgctaggaggatcacaggctgctgccctgggggacgccccgggaggtgaggagagccagggacgcctggtggtctcctactgtcggtcagaggaccgaattctgttgctgaagcgaaagcttccccctccgcgaccgtccgactcttttgcctgcttgtggaagacgtggacgggtcacgtgtgtctggatctgttggtttctgttttgtgtgtctttgtcttgtgtgtccttgtctacagttttaatatgggacagacggtgacgacccctcttagtttgactctcgaccattggactgaagttaaatccagggctcataatttgtcagttcaggttaagaagggaccttggcagactttctgtgtctctgaatggccgacattcgatgttggatggccatcagaggggacctttaattctgagattatcctggctgttaaagcaattatttttcagactggacccggctctcatcccgatcaggagccctatatccttacgtggcaagatttggcagaggatcctccgccatgggttaaaccatggctgaataagccaagaaagccaggtccccgaattctggctcttggagagaaaaacaaacactcggctgaaaaagtcaagccctctcctcatatctaccccgagattgaggagccaccggcttggccggaaccccaatctgttcccccacccccttatctggcacagggtgccgcgaggggaccctttgcccctcctggagctccggcggtggagggacctgctgcagggactcggagccggaggggcgccaccccggagcggacagacgagatcgcgacattaccgctgcgcacgtacggccctcccacaccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctattagaggctagaaaaaatgttcctggggccgacgggcgacccacgcggttgcaaaatgagattgacatgggatttcccttaactcgccccggttgggactacaacacggctgaaggtagggagagcttgaaaatctatcgccaggctctggtggcgggtctccggggcgcctcaagacggcccactaatttggctaaggtaagagaagtgatgcagggaccgaatgaacccccctctgtttttcttgagaggctcttggaagccttcaggcggtacaccccttttgatcccacctcagaggcccaaaaagcctcagtggctttggcctttataggacagtcagccttggatattagaaagaagcttcagagactggaagggttacaggaggctgagttacgtgatctagtgaaggaggcagagaaagtatattacaaaagggagacagaagaagaaagggaacaaagaaaagagagagaaagagaggaaagggaggaaagacgtaataaacggcaagagaagaatttgactaagatcttggctgcagtggttgaagggaaaagcaatacggaaagagagagagattttaggaaaattaggtcaggccctagacagtcagggaacctgggcaataggaccccactcgacaaggaccaatgtgcatattgtaaagaaagaggacactgggcaaggaactgccccaagaagggaaacaaaggaccaaggatcctagctctagaagaagataaagattaggggagacggggttcggaccccctccccgagcccagggtaactttgaaggtggaggggcaaccagttgagttcctggttgataccggagcgaaacattcagtgctactacagccattaggaaaactaaaagataaaaaatcctgggtgatgggtgccacagggcaacaacagtattcatggactacccgaagaacagttgacttgggagtgggacgggtaacccactcgtttctggtcatacctgagtgcccagcacccctcttaggtagagacttattgaccaagatgggagcacaaatttcttttgaacaagggaaaccagaagtgtctgcaaataacaaacctatcactgtgttgaccctccaattagatgacgaatatcgactatactctcccctagtaaagcctgatcaaaatatacaattctggttggaacagtttccccaagcctgggcagaaaccgcagggatgggtttggcaaagcaagttcccccacaagttattcaactgaaggccagtgccacaccagtgtcagtcagacagtaccccttgagtaaagaagctcaagaaggaattcggccgcatgtccaaagattaatccaacagggcatcctagttcctgtccaatctccctggaatactcccctgctaccggttagaaagcctgggactaatgactatcgaccagtacaggacttgagagaggtcaataaacgggtgcaggatatacacccaacagtcccgaacccttataacctcttgtgtgctctcccaccccaacggagctggtatacagtattggacttaaaggatgcctttttctgcctgagattacaccccactagccaaccactttttgccttcgaatggagagatccaggtacgggaagaaccgggcagctcacctggacccgactgccccaagggttcaagaactccccgaccatctttgacgaagccctacacagagacctggccaacttcaggatccaacaccctcaggtgaccctcctccagtacgtggatgacctgcttctggcgggagccaccaaacaggactgcttagaaggcacgaaggcactactgctggaattgtctgacctaggctacagagcctctgctaagaaggcccagatttgcaggagagaggtaacatacttggggtacagtttgcgggacgggcagcgatggctgacggaggcacggaagaaaactgtagtccagataccggccccaaccacagccaaacaaatgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccggggagttttaacccaaaccctaggaccatggagaagacctgtcgcctacctgtcaaagaagctcgatcctgtagccagtggttggcccatatgcctgaaggctatcgcagctgtggccatactggtcaaggacgctgacaaattgactttgggacagaatataactgtaatagccccccatgcattggagaacatcgttcggcagcccccagaccgatggatgaccaacgcccgcatgacccactatcaaagcctgcttctcacagagagggtcacgttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaggatggctggggcggcggtggtggacgggacccgcacgatctgggccagcagcctgccggaaggaacttcagcacaaaaggctgagctcatggccctcacgcaagctttgcggctggccgaagggaaatccataaacatttatacggacagcaggtatgcctttgcgactgcacacgtacatggggccatctataaacaaagggggttgcttacctcagcagggagggaaataaagaacaaagaggaaattctaagcctattagaagccgtacatttaccgaaaaggctagctattatacactgtcctggacatcagaaagctaaagatctcatatccagaggaaaccagatggctgaccgggttgccaagcaggcagcccagggtgttaaccttctgcctataatagaaatgcccaaagccccagaacccagacgacagtacaccctagaagactggcaagagataaaaaagatagaccagttctctgagactccggaagggacctgctatacctcagatgggaaggaaatcctgccccacaaagaagggttagaatatgtccaacagatacatcgtctaacccacctaggaactaaacacctgcagcagttggtcagaacatccccttatcatgttctgaggctaccaggagtggctgactcggtggtcaaacattgtgtgccctgccagctggttaatgctaatccttccagaatgcctccagggaagagactaaggggaagccacccaggcgctcactgggaagtggacttcactgaggtaaagccggctaaatacggaaacaaatacctattggtttttgtagacaccttttcaggatgggtagaggcttatcctactaagaaagagacttcaaccgtggtggctaaaaaaatactggaagaaatttttccaagatttggaatacctaaggtaatagggtcagacaatggtccagcttttgttgcccaggtaagtcagggactggccaagatattggggattgattggaaactgcattgtgcatacagaccccaaagctcaggacaggtagagaggatgaatagaaccattaaagagacccttactaaattgaccgcggagactggcgttaatgattggatagctctcctgccctttgtgctttttagggttaggaacacccctggacagtttgggctgaccccctatgaattactctacgggggaccccccccattggtagaaattgcttctgtacatagtgctgacgtgctgctttcccagcctttgttctctaggctcaaggcacttgagtgggtgagacaacgagcgtggaggcaactccgggaggcctactcaggaggaggagacttgcagatcccacatcgtttccaagtgggagattcagtctacgttagacgccaccgtgcaggaaacctcgagactcggtggaagggcccttatcacgtacttttgaccacaccaacggctgtgaaagtcgaaggaatctccacctggatccatgcatcccacgttaagccggcgccacctcccgattcggggtggaaagccgaaaagactgaaaatccccttaagcttcgcctccatcgcgtggttccttactctgtcaataacctctcagactaatggtatgcgcataggagacagcctgaactcccataaacccttatctctcacctggttaattactgactccggcacaggtattaatatcaacaacactcaaggggaggctcctttaggaacctggtggcctgatctatacgtttgcctcagatcagttattcctagtctgacctcacccccagatatcctccatgctcacggattttatgtttgcccaggaccaccaaataatggaaaacattgcggaaatcccagagatttcttttgtaaacaatggaactgtgtaacctctaatgatggatattggaaatggccaacctctcagcaggatagggtaagtttttcttatgtcaacacctataccagctctggacaatttaattacctgacctggattagaactggaagccccaagtgctctccttcagacctagattacctaaaaataagtttcactgagaaaggaaaacaagaaaatatcctaaaatgggtaaatggtatgtcttggggaatggtatattatggaggctcgggtaaacaaccaggctccattctaactattcgcctcaaaataaaccagctggagcctccaatggctataggaccaaatacggtcttgacgggtcaaagacccccaacccaaggaccaggaccatcctctaacataacttctggatcagaccccactgagtctaacagcacgactaaaatgggggcaaaactttttagcctcatccagggagcttttcaagctcttaactccacgactccagaggctacctcttcttgttggctatgcttagctttgggcccaccttactatgaaggaatggctagaagagggaaattcaatgtgacaaaagaacatagagaccaatgcacatggggatcccaaaataagcttacccttactgaggtttctggaaaaggcacctgcataggaaaggttcccccatcccaccaacacctttgtaaccacactgaagcctttaatcaaacctctgagagtcaatatctggtacctggttatgacaggtggtgggcatgtaatactggattaaccccttgtgtttccactttggtttttaaccaaactaaagatttttgcattatggtccaaattgttccccgagtgtattactatcccgaaaaagcaatccttgatgaatatgactacagaaatcatcgacaaaagagagaacccatatctctgacacttgctgtgatgctcggacttggagtggcagcaggtgtaggaacaggaacagctgccctggtcacgggaccacagcagctagaaacaggacttagtaacctacatcgaattgtaacagaagatctccaagccctagaaaaatctgtcagtaacctggaggaatccctaacctccttatctgaagtagtcctacagaatagaagagggttagatttattatttctaaaagaaggaggattatgtgtagccttgaaggaggaatgctgtttttatgtggatcattcaggggccatcagagactccatgaacaagcttagagaaaggttggagaagcgtcgaagggaaaaggaaactactcaagggtggtttgagggatggttcaacaggtctccttggttggctaccctactttctgctttaacaggacccttaatagtcctcctcctgttactcacagttgggccatgtattattaacaagttaattgccttcattagagaacgaataagtgcagtccagatcatggtacttagacaacagtaccaaagcccgtctagcagggaagctggccgctagctctaccagttctaagattagaactattaacaagagaagaagtggggaatgaaaggatgaaaatacaacctaagctaatgagaagcttaaaattgttctgaattccagagtttgttccttataggtaaaagattaggttttttgctgttttaaaatatgcggaagtaaaataggccctgagtacatgtctctaggcatgaaacttcttgaaactatttgagataacaagaaaagggagtttctaactgcttgtttagcttctgtaaaactggttgcgccataaagatgttgaaatgttgatacacatatcttggtgacaacatgtctcccccaccccgaaacatgcgcaaatgtgtaactctaaaacaatttaaattaattggtccacgaagcgcgggctctcgaagttttaaattgactggtttgtgatattttgaaatgattggtttgtaaagcgcgggctttgttgtgaaccccataaaagctgtcccgactccacactcggggccgcagtcctctacccctgcgtggtgtacgactgtgggccccancgcgcttggaataaaaatcctcttgctgtttgcatcaagaccgcttctcgtgagtgattaaggggagtcgccttttccgagcctggaggttctttttgctggtcttacaggtttaatttagctaactctgtgtttttcttgaaccatgttttacaattcctttctaggatgtaatttgcttgcttcttctcctaccgtccagagattctgct

SEQ ID NO: 271 - DNA, 8904 bp, artificial
  338173805_C sequence
aatgaaaggatgaaaatacaacctaagctaatgagaagcttaaaattgttctgaattccagagtttgttccttataggtaaaagattaggttttttgctgttttaaaatatgcggaagtaaaataggccctgagtacatgtctctaggcatgaaacttcttgaaactatttgagataacaagaaaagggagtttctaactgcttgtttaacttctgtaaaactggttgcgccataaagatgaagaaaagggagtttctaactgcttgtttagcttctgtaaaactgcttgcaaaagatagaaggagaggaggttaatttctaaagcaacctcaaattggttgcgccataaagatgttgaaatgttgatacacatatcttggtgacaacatgtctcccccaccccgaaacatgcgcaaatgtgtaactccaaaacaatttaaattaattggtccacgaagcgcgggctctcgaagttttaaattgactggtttgtgatattttgaaatgattggcttgtaaagcgcgggctttgttgtgaaccccataaaagctgtcccgactccacactcggggccgcagtcctctacccctgcgtggtgtacgactgtgggccccagcgcgcttggaataaaaatcctcttgctgtttgcatcaagaccgcttctcgtgagtgattaaggggagtcgccttttccgagcctggaggttctttttgctggtcttacatttgggggctcgtccgggatctgttgcggccacccctaacacccgagaaccgacttggaggtaaaaaggatcctctttttaacgtgtatgcatgtaccggccggcgtctctgttctgagtgtctgttttcagtggtgcgcgctttcggtttgcagctgtcctctcaggccgtaagggctgggggactgtgatcagcagacgtgctaggaggatcacaggctgccaccctgggggacgccccgggaggtggggagagccagggacgcctggtggtctccttctgtcggtcagaggaccgagttctgttgttgaagcgaaagcttccccctccgcggccgtccgactcttttgcctgcttgtggaagacgcggacgggtcgcgtgtgtctggatctgttggtttctgttttgtgtgtctttgtcttgtgtgtccttgtctacagttttaatatgggacagacggtgacgacccctcttagtttgactctcgaccattggactgaagttaaatccagggctcataatttgtcagttcaggttaagaagggaccttggcagactttctgtgtttctgaatggccgacattcgatgttggatggccatcagaggggacctttaattctgagattatcctggctgttaaagcaattatttttcagactggacccggctctcatcccgatcaggagccctatatccttacatggcaagatttggcagaggatcctccgccatgggttaaaccatggctgaataagccaagaaagccaggtccccgaattctggctcttggagagaaaaacaaacactcggctgaaaaagtcaagccctctcctcatatctaccccgagattgaggagccaccggcttggccagaaccccaatctgttcccccacccccttatctggcacagggtgccgcgaggggaccctttgcccctcctggagctccggcggtggagggacctgctgcagggactcggagccggaggggcgccaccccggagcggacagacgagatcgcgacattaccgctgcgcacgtacggccctcccacaccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaacttggctaaggtaagagaggtgatgcagggaccgaatgaacctccctcagtttttcttgagaggctcatggaagccttcaggcggttcaccccttttgatcctacctcggaggctcagaaagcctcagtggctctggccttcataggacagtcagccctggatatcagaaagaagcttcagagactggaagggttacaggaggctgagttacgtgatctagtgaaggaggcagagaaagtgtattacaaaagggagacagaagaagaaagggaacaaagaaaagagagagaaagagaggaaagggaggaaagacgtaataaacggcaagagaagaatttgactaagatcttggctgcagtggttgaagggaaaagcaatacggaaagagagagagattttaggaaaattaggtcaggccctagacagtcagggaacctgggcaataggaccccactcgacaaggaccaatgtgcatattgtaaagaaagaggacactgggcaagggactgccccaagaagggaaacaaaggactgaaggtcttagctctggaagaagataaagactagggaagacggggttcggaccccctccccgagcccagggtaactttaaaggtggaggggcaaccagttgagtttctggttgataccggagcgaaacattcagtgctactacagccattaggaaaactaaaagataaaaaatcctgggtgatgggtgccacagggcaacaacagtattcatggactacccgaagaacagttgacttgggagtgggacgggtaacccactcgtttctggtcatacctgagtgcccagcacccctcttaggtagagacttattgaccaagatgggagcacaaatttcttttgaacaagggaaaccagaagtgtctgcaaataacaaacctatcactgtgttgaccctccaattagatgacgaatatcgactatactctcccctagtaaagcctgatcaaaatatacaattctggttggaacagtttccccaagcctgggcagaaaccgcagggatgggtttggcaaagcaagttcccccacaagttattcaactgaaggccagtgccacaccagtgtcagtcagacagtaccccttgagtaaagaagctcaagaaggaattcggccgcatgtccaaagattaatccaacagggcatcctagttcctgtccaatctccctggaatactcccctgctaccggttagaaagcctgggactaatgactatcgaccagtacaggacttaagagaggtcaataaacgggtgcaggatatacacccaacagtcccgaacccttataacctcttgtgtgctctcccaccccaacggagctggtatacagtattggacttaaaggatgccttcttctgcctgagattacaccccactagccaaccactttttgccttcgaatggagagatccagatacgggaagaaccgggcagctcacctggacccgactgccccaagggttcaaaaactccccgaccatctttgacgaagccctacacagagacctggccaacttcaggatccaacacccccaggtgaccctcctccagtacgtggatgacctgcttctggcgggagccaccaaacaggactgcttagaaggcacgaaggcactactgctggaattgtctgacctaggctacagagcctctgctaagaaggcccagatttgcaggagagaggtaacatacttggggtacagtttgcgggacgggcagcgatggctgacggaggcacggaagaaaactgtagtccagataccggccccaaccacagccaaacaaatgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtgactaaaccctttaccctttatgtggatgagcgtaagggagtagcccggggagttttaacccaaactctaggaccatggaggagacctgttgcctacctgtcaaagaagctcgatcctgtagccagtggttggcccgtatgcctgaaggctatcgcagctgtggccatactggtcaaggacgctgacaaattgactttgggacagaatataactgtaatagccccccatgcgttggagaacatcgttcggcagcccccagaccgatggatgaccaacgcccgcatgacccactatcaaagcctgcttctcacagagagggtcacgttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaggatggctggggcggcggtggtggacgggacccgcacgatctgggccagcagcctgccggaaggaacttcagcacaaaaggctgagctcatggccctcacgcaagctttgcggctggccgaagggaaatccataaacatttatacagacagcaggtatgcctttgcgactgcacacgtacacggggccatctataagcaaagggggttgcttacctcagcagggagggaaataaagaacaaagaggaaattctaagcctattagaagccttacatttgccaaaaaggctagctattatacactgtcctggacatcagaaagccaaagatcccatatccagagggaaccagatggctgaccgggttgccaagcaggcagcccagggtgttaaccttctgcctatgatagaaacacccaaagccccagaacccggacgacagtacaccctagaagactggcaagaaataaaaaagatagaccagttctctgaaactccggaggggacctgctatacctcagatgggaaggaaatcctgccccacaaagaagggttagaatatgtccaacagatacatcgtctaacccacctaggaactaaacacctgcagcagttggtcagaacatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccggctaaatacggaaacaaatacctattggtttttgtagacaccttttcaggatgggtagaggcttatcctactaagaaagagacttcaaccgtggtggctaaaaaaatactggaagaaatttttccaagatttggaatacctaaggtaatagggtcagacaatggtccagcttttgttgcccaggtaagtcagggactggccaagatattggggattgattggaaactgcattgtgcatacagaccccaaagctcaggacaggtagagaggatgaatagaaccattaaagagacccttactaaattgaccgcggagactggcgttaatgattggatagctctcctgccctttgtgctttttagggtgaggaacacccctggacagtttgggctgaccccctatgaattactctacgggggaccccccccattggtagaaattgcttctgtacatagtgctgatgtgctgctttcccagcctttgttctctaggctcaaggcacttgagtgggtgagacaacgagcgtggaggcaactccgggaggcctactcaggaggaggagacttgcagatcccacatcgtttccaagtgggagattcagtctacgttagacgccaccgtgcaggaaacctcgagactcggtggaagggcccttatctcgtacttttgaccacaccaacggctgtgaaagtcgaaggaatctccacctggatccatgcatcccacgttaagccggcgccacctcccgattcggggtggaaagccgaaaagactgaaaatccccttaagcttcgcctccatcgcgtggttccttactctgtcaataacctctcagactaatggtatgcgcataggagacagcctgaactcccataaacccttatctctcacctggttaattactgactccggcacaggtattaatatcaacaacactcaaggggaggctcctttaggaacctggtggcctgatctatacgtttgcctcagatcagttattcctagtctgacctcacccccagatatcctccatgctcacggattttatgtttgcccaggaccaccaaataatggaaaacattgcggaaatcccagagatttcttttgtaaacaatggaactgtgtaacctctaatgatggatattggaaatggccaacctctcagcaggatagggtaagtttttcttatgtcaacacctataccagctctgaacaatttaattacctgacctggattagaactggaagccccaagtgctctccttcagacctagattacctaaaaataagtttcactgagaaaggaaaacaagaaaatatcctaaaatgggtaaatggtatgtcttggggaatggtatattatggaggctcgggtaaacaaccaggctccattctaactattcgcctcaaaataaaccagctggagcctccaatggctataggaccaaatacggtcttgacgggtcaaagacccccaacccaaggaccaggaccatcctctaacataacttctggatcagaccccactgagtctaacagcacgactaaaatgggggcaaaactttttagcctcatccagggagcttttcaagctcttaactccacgactccagaggctacctcttcttgttggctttgcttagcttcgggcccaccttactatgagggaatggctagaagagggaaattcaatgtgacaaaagaacatagagaccaatgcacatggggatcccaaaataagcttacccttactgaggtttctggaaaaggcacctgcataggaaaggttcccccatcccaccaacacctttgtaaccacactgaagcctttaatcaaacctctgagagtcaatatctggtacctggttatgacaggtggtgggcatgtaatactggattaaccccttgtgtttccactttggtttttaaccaaactaaagatttttgcattatggtccaaattgttccccgagtgtattactatcccgaaaaagcaatccttgatgaatatgactacagaaatcatcgacaaaagagagaacccatatctctgacacttgctgtgatgctcggacttggagtggcagcaggtgtaggaacaggaacagctgccctggtcacgggaccacagcagctagaaacaggacttagtaacctacatcgaattgtaacagaagatctccaagccctagaaaaatctgtcagtaacctggaggaatccctaacctccttatctgaagtagtcctacagaatagaagagggttagatttattatttctaaaagaaggaggattatgtgtagccttgaaggaggaatgctgtttttatgtggatcattcaggggccatcagagactccatgaacaagcttagagaaaggttggagaagcgtcgaagggaaaaggaaactactcaagggtggtttgagggatggttcaacaggtctccttggttggctaccctactttctgctttaacaggacccttaatagtcctcctcctgttactcacagttgggccatgtattattaacaagttaattgccttcattagagaacgaataagtgcagtccagatcatggtacttagacaacagtaccaaagcccgtctagcagggaagctggccgctagctctaccagttctaagattagaactattaacaagagaagaagtggggaatgaaaggatgaaaatacaacctaagctaatgagaagcttaaaattgttctgaattccagagtttgttccttataggtaaaagattaggttttttgctgttttaaaatatgcggaagtaaaataggccctgagtacatgtctctaggcatgaaacttcttgaaactatttgagataacaagaaaagggagtttctaactgcttgtttaacttctgtaaaactggttgcgccataaagatgaagaaaagggagtttctaactgcttgtttagcttctgtaaaactgcttgcaaaagatagaaggagaggaggttaatttctaaagcaacctcaaattggttgcgccataaagatgttgaaatgttgatacacatatcttggtgacaacatgtctcccccaccccgaaacatgcgcaaatgtgtaactccaaaacaatttaaattaattggtccacgaagcgcgggctctcgaagttttaaattgactggtttgtgatattttgaaatgattggtttgtaaagcgcgggctttgttgtgaaccccataaaagctgtcccgactccacactcggggccgcagtcctctacccctgcgtggtgtacgactgtgggccccagcgcgcttggaataaaaatcctcttgctgtttgcatcaagaccgcttctcgtgagtgattaaggggagtcgccttttccgagcctggaggttctttttgctggtcttacatt

SEQ ID NO: 272 - DNA, 8918 bp, artificial
  25811406_A sequence
tgaaaggatgaaaatgcaacctaactctcccagaacccaggaagttaataagaagctctaaatgccctcgaaatccagaccctgttccctataggtaaaagatcatactttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcataagataaaaagaggagaagtcaattgcctaacggaccccagtaagatcgggcgtgccacaaaatgttgaaaatcctgataaatatatcttggtgacaatatgtctcccccacccagagacaggcacaaacatgtaactccagaacaacttaaaattaattggtccacaaagcgcgggctctcgaagttttgaattgactggtttgcgatattttaaaaatgattagtttgtaaaagcgcgggctttgttgtgaaccccataaaagctgtcccgactccacactcggggccgcagtcctctacccctgcgtggcgtacgactgtgggccccagcgcgctcggaataaaaatcctcttgctgtttgcatcaagaccgcttctcgtgagtgatttggggtgtcgcctcttccgagtcaggacgagagggattttaactcgactggcctttcagtttggtgcgttggccgggaaacccgcgactacccctcacacccgagaaccgacttggaggtaaagggatcccctttggaacgtgtgagtgtgtgtgtcggctggcgtctctgttctgagtgtctgttttcggtgatgcgcgctttcggtttgcagctgtcctctcagaccgtaaggactgggggactgtgatcagcagacgtgctaggaggatcacaggctgccaccctgggggacgccccgggaggtggggagagccagggacgcctggtggtctccttctgtcggtcagaggaccgagttctgttgttgaagcgaaagcttccccctccgcggccgtccgactcttttgcctgcttgtggaagacgcggacgggtcgcgtgtgtctggatctgttggtttctgttttgtgtgtctttgtcttgtgcgtccttgtctacagttttaatatgggacagacggtgacgacccctcttagtttgactctcgaccattggactgaagttaaatccagggctcataatttgtcagttcaggttaagaagggaccttggcagactttctgtgtctctgaatggccgacattcgatgttggatggccatcagaggggacctttaattctgagattatcctggctgttaaagcaattatttttcagactggacccggctctcatcccgatcaggagccctatatccttacgtggcaagatttggcagaggatcctccgccatgggttaaaccttggctgaataagccaagaaagccaggtccccgaattctggctcttggagagaaaaacaaacactcggctgaaaaagtcaagccctctcctcatatctaccccgagattgaggagccgccggcttggccggaaccccaatctgttcccccacccccttatccggcacagggtgctgcgaggggaccctctgcccctcctggagctccggcggtggagggacctgctgcagggactcggagccggaggggcgccaccccggagcggacagacgagatcgcgacattaccgctgcgcacgtacggccctcccataccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgaaagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaacttggctaaggtaagagaggtgatgcagggaccgaatgaacctccctcagtttttcttgagaggctcatggaagccttcaggcggttcaccccttttgatcctacctcggaggctcagaaagcctcaatggctctggccttcataggacagtcagccctggatatcagaaagaagcttcagagactggaagggttacaggaggctgagttacatgatctagtgaaggaggcagagaaagtgtattacaaaagggagacagaagaagaaagggaacaaagaaaagagagagaaagagaggaaagggaggaaagacgtaataaacggcaagagaagaatttgactaagatcttggctgcagtggttgaagggaaaagcaatagggaaagagagagagattttaggaaaattaggtcaggccctagacagtcagggaacctgggcaataggaccccactcgacaaggaccaatgtgcatattgtaaagaaaaaggacactgggcaagggactgccccaagaagggaaacaaaggactgaaggtcttagctctggaagaagataaagactagggaagacggggttcggaccccctccccgagcccagggtaactttaaaggtggaggggcaaccagttgagtttctggttgataccggagcgaaacattcagtgctactacagccattaggaaaactaaaagataaaaaatcctgggtgatgggtgccacagggcaacaacaatatccatggactacccgaagaacagttgacttgggagtgggacgggtaacccactcgtttctggtcatacctgagtgcccagcacccctcttaggtagagacttactgaccaagatgggagcacaaatttcttttgaacaagggaaaccagaagtgtctgcaaataacaaacctatcactgtgttgaccctccaattagatgacgaatatcgactatattctcccctagtaaagcctgatcaaaatatacaattctggttggaacagtttccccaagcctgggcagaaaccgcagggatgggtttggcaaagcaagttcccccacaggttattcaactgaaggccagtgctgcaccagtgtcagtcagacagtaccccttgagtaaagaagctcgagaaggaattcggccgcatgttcaaagattaatccaacagggcatcctagttcctgtccaatctccctggaatactcccctgctaccggttagaaagcctgggactaatgactatcgaccagtacaggacttgagagaggtcaataaacgggtgcaggatatacacccaacagtcccgaacccttataacctcttgtgtgctctcccaccccaacggagctggtatacagtattggacttaaaggatgccttcttctgcctgagactacatcccactagccaaccactttttgccttcgaatggagagatccaggtgcgggaagaaccgggcagctcacttggactcgactgccccaagggttcaaaaactccccgaccatctttgacgaagccctacacagagacctggccaacttcaggatccaacacccccaggtgaccctcctccagtacgtggatgacctgcttctggcgggagccaccaaacaggactgcttagaaggtacgaaggcactactgctggaattgtctgacctaggctacagagcctccgctaagaaggcccagatttgcaggagagaggtaacatacttggggtacagtttgcggggcgggcagcgatggctgacggaggcacggaagagaactgtagtccagataccggccccaaccacagccaaacaagtgagagagtttttggggacagctggattttgcagactgtggatcccggggtttgcgaccttagcagccccactctacccactaaccaaagaaaaaggggaattctcctgggctcctgagcaccagaaggcatttgatgctatcaaaaaggccctgctgagcgcacctgctctggccctccctgacgtgactaaaccctttaccctttatgtggatgagcgtaagggagtagcccggggagttttaacccaaactctaggaccatggaggagacctgttgcctacctgtcaaagaagctcgatcctgtagccagtggttggcccatatgcctgaaggctatcgcagctgtggccatactggtcaaggacgctgacaaattgactttgggacagaatataactgtaatagccccccatgcgttggagaacatcgttcggcagcccccagaccgatggatgaccaacgcccgcatgacccactatcaaagcctgcttctcacagagagggtcacgttcgctccaccagccgctctcaaccctgccactcttctgcctgaagagactgatgaaccagtgactcatgattgccatcaactattgattgaggagactggggtccgcaaggaccttacagacataccgctgactggagaaatgttaacctggttcactgacggaagcagctatatggtggaaggtaagaggatggctggggcggcggtggtggacgggacccgcacgatctgggccagcagcctgccggaaggaacttcagcacaaaaggctgagctcatggccctcacgcaagctttgcggctggccgaagggaaatccataaacatttatacagacagcaggtatgcctttgcgactgcacacgtacacggggccatctataagcaaagggggttgcttacctcagcagggagggaaataaagaacaaagaggaaattctaagcctattagaagccttacatttgccaaaaaggctagctattatacactgtcctggacatcagaaagccaaagatcccatatccagagggaaccagatggctgaccgggttgccaagcaggcagcccagggtgttaaccttctgcctatgatagaaacacccaaagccccagaacccggacgacagtacaccctagaagactggcaagaaataaaaaagatagaccagttctctgaaactccggaggggacctgctatacctcagatgggaaggaaatcctgccccacaaagaagggttagaatatgtccaacagatacatcgtctaacccacctaggaactaaacacctgcagcagttggtcagaacatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaagaaaatactggaggaaatttttccaagatttggaatacctaaggtaatagggtcagacaatggtccagctttcgttgcccaggtaagtcagggactggccaagatattggggattgattggaaactgcattgtgcatacagaccccaaagctcaggacaggtagagaggatgaatagaaccattaaagagacccttaccaaattgaccacagagactggcattaatgattggatggctctcctgccctttgtgctttttagggtgaggaacacccctggacagtttgggctgaccccctatgaattgctctacgggggaccccccccgttggcagaaattgcctttgcacatagtgctgatgtgctgctttcccagcctttgttctctaggctcaaggcgctcgagtgggtgaggcagcgagcgtggaagcagctccgggaggcctactcaggaggagacttgcaagttccacatcgcttccaagttggagattcagtctatgttagacgccaccgtgcaggaaacctcgagactcggtggaagggaccttatctcgtacttttgaccacaccaacggctgtgaaagtcgaaggaatccccacctggatccatgcatcccacgttaagccggcgccacctcccgattcggggtggaaagccgaaaagactgaaaatccccttaagcttcgcctccatcgcgtggttccttactctgtcaataactcctcaagttaatggtaaacgccttgtggacagcccgaactcccataaacccttatctctcacctggttacttactgactccggtacaggtattaatattaacagcactcaaggggaggctcccttggggacctggtggcctgaattatatgtctgccttcgatcagtaatccctggtctcaatgaccaggccacaccccccgatgtactccgtgcttacgggttttacgtttgcccaggacccccaaataatgaagaatattgtggaaatcctcaggatttcttttgcaagcaatggagctgcataacttctaatgatgggaattggaaatggccagtctctcagcaagacagagtaagttactcttttgttaacaatcctaccagttataatcaatttaattatggccatgggagatggaaagattggcaacagcgggtacaaaaagatgtacgaaataagcaaataagctgtcattcgttagacctagattacttaaaaataagtttcactgaaaaaggaaaacaagaaaatattcaaaagtgggtaaatggtatatcttggggaatagtgtactatggaggctctgggagaaagaaaggatctgttctgactattcgcctcagaatagaaactcagatggaacctccggttgctataggaccaaataagggtttggccgaacaaggacctccaatccaagaacagaggccatctcctaacccctctgattacaatacaacctctggatcagtccccactgagcctaacatcactattaaaacaggggcgaaactttttagcctcatccagggagcttttcaagctcttaactccacgactccagaggctacctcttcttgttggctttgcttagcttcgggcccaccttactatgagggaatggctagaggagggaaattcaatgtgacaaaggaacatagagaccaatgtacatggggatcccaaaataagcttacccttactgaggtttctggaaaaggcacctgcatagggatggttcccccatcccaccaacacctttgtaaccacactgaagcctttaatcgaacctctgagagtcaatatctggtacctggttatgacaggtggtgggcatgtaatactggattaaccccttgtgtttccaccttggttttcaaccaaactaaagacttttgcgttatggtccaaattgtcccccgggtgtactactatcccgaaaaagcagtccttgatgaatatgactatagatataatcggccaaaaagagagcccatatccctgacactagctgtaatgctcggattgggagtggctgcaggcgtgggaacaggaacggctgccctaatcacaggaccgcaacagctggagaaaggacttagtaacctacatcgaattgtaacggaagatctccaagccctagaaaaatctgtcagtaacctggaggaatccctaacctccttatctgaagtggttctacagaacagaagggggttagatctgttatttctaaaagaaggagggttatgtgtagccttaaaagaggaatgctgcttttatgtggatcattcaggagctatcagggactccatgagcaagctcagagaaaggttagaaaaacgtcacaaagaaaaagaggctggccaaggatggtttgagggatggttcaacaagtccccatgggtgaccaccctgctttctgctctaacaggacccctagtaatactgctcctgttgcttacagttgggccttgcttaattaatcggtttgttgcctttgttagagaacaagtgagtgcagttcggatcatggtacttagacagcagtaccaaggccttccaagctaaggagaaactgacctttagccttcctagttctaagattagaactattaacaagagaagaagtggggaatgaaaggatgaaaatgcaacctgactctcccagaacccaggaagttaataagaagctctaaatgccctcgaattccagaccctgttccctataggtaaaagatcatactttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcataagataaaaagaggagaagtcaattgcctaacggaccccagtaagatcgggcgtgccacaaaatgttgaaaatcctgataaatatatcttggtgacaatatgtctcccccacccagagacaggcacaaacatgtaactccagaacaacttaaattaattggtccacaaagcgcgggctctcgaagttttgaattgactggtttgcgatattttaaaaatgattagtttgtaaaagcgcgggctttgttgtgaaccccataaaagctgtcccgactccacactcggggccgcagtcctctacccctgcgtggcgtacgactgtgggccccagcgcgctcggaataaaaatcctcttgctgtttgcatcaagaccgcttctcgtgagtgatttggggtgtcgcctcttccgagtcaggacgagagggattttaactcgactggcctttcag

SEQ ID NO: 273 - DNA, 8763 bp, artificial
  25811407_B sequence
  misc_feature (6938)..(6938): n is a, c, g, or t
tgaaaggatgaaaatgcaacctaaccctcccagaacccaggaagttaataaaaagctctaaaatgccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgacagccctagtgacctatctcaactgcaatctgtcactctgcccaggagcccacgcagatgcggacctccggagctatttttaaaatgattggtccacggagcgcgggctctcgatattttaaaatgattggtccatggagcgcgggctctcgatattttaaaatgattggtttgtgacgcacaggctttgttgtgaaccccataaaagctgtcccgattccgcactcggggccgcagtcctctacccctgcgtggtgtacgactgtgggccccagcgcgcttggaataaaaatcctcttgctgtttgcatcaagaccgcttcttgtgagtgatttggggtgtcgcctcttccgagcccggacgagggggattgttcttttactggcctttcatttggtgcgttggccgggaaatcctgcgaccaccccttacacccgagaaccgacttggaggtaaagggatcccctttggaacgtgtgtgtgtgtcggccggcgtctatgttctgagtgtctgttttcggtaatgcgcgctttcggtttgcagctgtcctctcagaccgtaaggactggaggactgtgatcagcagacgtgttaggaggatcacaggctgccaccctggggaacgccccggaaggtgggaagagccaggaacgcctggtggtctcctactgtcggtcagaggtccgagttctgttgttgaagcgaaagcttccccctccgcggccgtccgactcttttgcctgcttgtggaagacgcggacgggtcgcgtgtgtctggatctgttggtttctgtttcgtgtgtctttgtcttgtgcgtccttgtctacagttttaatatgggacagacagtgactaccccccttagtttgactctcgaccattggactgaagttagatccagggctcataatttgtcagttcaggttaagaagggaccttggcagactttctgtgcctctgaatggccaacattcgatgttggatggccatcagaggggacctttaattctgaaattatcctggctgttaaggcaatcatttttcagactggacccggctctcatcctgatcaggagccctatatccttacgtggcaagatttggcagaagaacctccgccatgggttaaaccatggctaaataaaccaagaaagccaggtccccgaatcctggctcttggagagaaaaacaaacactcggccgaaaaagtcgagccctctcctggtatctaccccgagatcgaggagccgccgacttggccggaaccccaacctgttcccccacccccttatccagcacagggtgctgtgaggggaccctctgcccctcctggagctccggtggtggagggacctgctgccgggactcggagccggagaggcgccaccccggagcggacagacgagatcgcgatattaccgctgcgcacctatggccctcccatgccagggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaatttggctaaggtaagagaggtgatgcagggaccgaacgaacctccctcggtatttcttgagaggctcatggaagccttcaggcggttcaccccttttgatcctacctcagaggcccagaaagcctcagtggccctggccttcattgggcagtcggctctggatatcagaaagaaacttcagagactggaagggttacaggaggctgagttacgtgatctagtgagagaggcagagaaggtgtattacagaagggagacagaagaggagaaggaacagagaaaagaaaaggagagagaagaaagggaggaaagacgtgatagacggcaagagaagaatttgactaagatcttggccgcagtggttgaagggaagagcagcagggagagagagagagattttaggaaaattaggtcaggccctagacagtcagggaacctgggcaataggaccccactcgacaaggaccagtgtgcgtattgtaaagaaaaaggacactgggcaaggaactgccccaagaagggaaacaaaggaccgaaggtcctagctctagaagaagataaagattaggggagacggggttcggaccccctccccgagcccagggtaactttgaaggtggaggggcaaccagttgagttcctggttgataccggagcggagcattcagtgctgctacaaccattaggaaaactaaaagaaaaaaaatcctgggtgatgggtgccacagggcaacggcagtatccatggactacccgaagaaccgttgacttggcagtgggacgggtaacccactcgtttctggtcatccctgagtgcccagtaccccttctaggtagagacttactgaccaagatgggagctcaaatttcttttgaacaaggaagaccagaagtgtctgtgaataacaaacccatcactgtgttgaccctccaattagatgatgaatatcgactatattctccccaagtaaagcctgatcaagatatacagtcctggttggagcagtttccccaagcctgggcagaaaccgcagggatgggtttggcaaagcaagttcccccacaggttattcaactgaaggccagtgctacaccagtatcagtcagacagtaccccttgagtagagaggctcgagaaggaatttggccgcatgttcaaagattaatccaacagggcatcctagttcctgtccaatccccttggaatactcccctgctaccggttaggaagcctgggaccaatgattatcgaccagtacaggacttgagagaggtcaataaaagggtgcaggacatacacccaacggtcccgaacccttataacctcttgagcgccctcccgcctgaacggaactggtacacagtattggacttaaaagatgccttcttctgcctgagattacaccccactagccaaccactttttgccttcgaatggagagatccaggtacgggaagaaccgggcagctcacctggacccgactgccccaagggttcaagaactccccgacattctttgacgaagccctacacagggacctggccaacttcaggatccaacaccctcaggtgaccctcctccagtacgtggatgacctgcttctggcgggagccaccaaacaggactgcttagaaggtacgaaggcactactgctggaattgtctgacctaggctacagagcctctgctaagaaggcccagatttgcaggagagaggtaacatacttggggtacagtttgcggggcgggcagcgatggctgacggaggcacggaagaaaactgtagtccagataccggccccaaccacagccaaacaagtgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccgaggagttttaacccaaaccctaggaccatggaggagacctgttgcctacctgtcaaagaagcttgatcctgtagccagtggttggcccgtatgcctgaaggctatcgcagctgtggccatactggtcaaggacgctgacaaattgactttgggacagaatataactgtaatagccccccatgcattggagaacatcgttcggcagcccccagaccgatggatgaccaacgcccgcatgacccactatcaaagcctgcttctcacagagagggtcactttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaagatggctggagcggcggtggtggacgggacccgcacgatctgggccagcagcctgccggaaggaacttcagcgcaaaaggctgagctcatggccctcacgcaagctttgcggctggccgaagggaaatccataaacatttatacggacagcaggtatgcctttgcgactgcacacgtacacggggccatctataaacaaagggggttgcttacctcagcagggagggaaataaagaacaaagaggaaattctaagcctattagaagccttacatttgccaaaaaggctagctattatacactgtcctggacatcagaaagccaaagatctcatatctagagggaaccagatggctgaccgggttgccaagcaggcagcccaggctgttaaccttctgcctataatagaaacgcccaaagccccagaacccagacgacagtacaccctagaagactggcaagagataaaaaagatagaccagttctctgagactccggaggggacctgctatacctcatatgggaaggaaatcctgccccacaaagaagggttagaatatgtccaacagatacatcgtctcacccacctaggaactaaacacctgcagcagttggtcagaacatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaaaaaaatactggaggaaatttttccgagatttggaatacctaaggtaatcgggtcagacaatggtccagcttttgttgcccaggtaagtcagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccctatgaattgctctacgggggaccccccccgttggtagaaattgcttctgtacatagtgctgatgtgctgctttcccagcctttgttctctaggctcaaggcgctcgagtgggtgaggcaacgagcgtggaagcagctccgggaggcctactcaggagaaggagacttgcaagttccacatcgcttccaagtgggagattcagtctatgttagacgccaccatgcaggaaacctcgagactcggtggaagggcccttatctcgtacttttgaccacaccaacggctgtgaaagtcgaaggaatctccacctggatccatgcatcccacgttaagctggcgccacctcccgactcggggtggagagccgaaaagactgagaatccccttaagcttcgcctccatcgcctggttccttactctaacaataactccccaggccagtagtaaacgccttatagacagctcgaacccccatagacctttatcccttacctggctgattattgaccctgatacgggtgtcactgtaaatagcactcgaggtgttgctcctagaggcacctggtggcctgaactgcatttctgcctccgattgattaaccccgctgttaaaagcacacctcccaacctagtccgtagttatgggttctattgctgcccaggcacagagaaagagaaatactgtgggggttctggggaatccttctgtaggagatggagctgcgtcacctccaacgatggagactggaaatggccgatctctctccaggaccgggtaaaattctcctttgtcaattccggcccgggcaagtacaaagtgatgaaactatataaagataagagctgctccccatcagacttagattatctaaagataagtttcactgaaaaaggaaaacaggaaaatattcaaaagtggataaatggtatgagctggggaatagttttttataaatatggcgggggagcagggtccactttaaccattcgccttaggatagagacggggacagaaccccctgtggcagtgggacccgataaagtactggctgaacaggggcccccggccctggagccaccgcataacttgccggtgccccaattaacctcgctgcggcctgacataacacagccgcctagcancagtaccactggattgattcctaccaacacgcctagaaactccccaggtgttcctgttaagacaggacagagactcttcagtctcatccagggagctttccaagccatcaactccaccgaccctgatgccacttcttcttgttggctttgtctatcctcagggcctccttattatgaggggatggctaaagaaggaaaattcaatgtgaccaaagagcatagaaatcaatgtacatgggggtcccgaaataagcttaccctcactgaagtttccgggaaggggacatgcataggaaaagctcccccatcccaccaacacctttgcaatagtactgtggtttatgagcaggcctcagaaaatcagtatttagtacctggttataacaggtggtgggcatgcaatactgggttaaccccctgtgtttccacctcagtcttcaaccaatccaaagatttctgtgtcatggtccaaatcgtcccccgagtgtactaccatcctgaggaagtggtccttgatgaatatgactatcggtataaccgaccaaaaagagaacccgtatcccttaccctagctgtaatgctcggattagggacggccgttggcgtaggaacagggacagctgccctgatcacaggaccacagcagctagagaaaggacttggtgagctacatgcggccatgacagaagatctccgagccttagaggagtctgttagcaacctagaagagtccctgacttctttgtctgaagtggttctacagaaccggaggggattagatctgctgtttctaagagaaggtgggttatgtgcagccttaaaagaagaatgttgcttctatgtagatcactcaggagccatcagagactccatgagcaagcttagagaaaggttagagaggcgtcgaagggaaagagaggctgaccaggggtggtttgaaggatggttcaacaggtctccttggatgaccaccctgctttctgctctgacggggcccctagtagtcctgctcctgttacttacagttgggccttgcttaattaataggtttgttgcctttgttagagaacgagtgagtgcagtccagatcatggtacttaggcaacagtaccaaggccttctgagccaaggagaaactgacctctagccttcccagttctaagattagaactattaacaagacaagaagtggggaatgaaaggatgaaaatgcaacctaaccctcccagaacccaggaagttaataaaaagctctaaatgcccccgaattccagaccctgctggctgccagtaaataggtagaaggtcacacttgctattgttccaaggcctgctatcctggcctaagtaagataacaggaaatgagttgactaatcgcttatctggattctgtaaaactgactggcaccatagaagaattgattacacattgacagccctagtgacctatctgaactgcaatctgtgactctggccagtagcccacgcagatgcggacctccggagctattttaaaatgattggtccacggagcgcgggctctcgatattttaaaatgattggtccatggagcgcgggctctcgatattttaaaatgattggtatgagacgcacaggctttgttgtgaaccccataaaagctgtcccgattccgcactcggggccgcagtcctctacccctgcgtggtgtacgactgtgggccccagcgcgcttggaataaaaatcctcttgctgtttgcatcaagaccgcttcttgtgagtgatttggggtgtcgcctcttccgagcccggacgagggggattgttcttttactggcctttca

SEQ ID NO: 274 - DNA, 8918 bp, artificial
  25811408_A sequence
tgaaaggatgaaaatgcaacctaactctcccagaacccaggaagttaataagaagctctaaatgccctcgaattccagaccctgttccctataggtaaaagatcatactttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcataagataaaaagaggagaagtcaattgcctaacggaccccagtaagatcgggcgtgccacaaaatgttgaaaatcctgataaatatatcttgatgacaatatgtctcccccacccagagacaggcacaaacatgtaactccagaacaacttaaaattaattggtccacaaagcgcgggctctcgaagttttgaattgactggtttgcgatattttaaaaatgattagtttgtaaaagcgcgggctttgttgtgaaccccataaaagctgtcccgactccacactcggggccgcagtcctctacccctgcgtggcgtacgactgtgggccccagcgcgctcggaataaaaatcctcttgctgtttgcatcaagaccgcttctcgtgagtgatttggggtgtcgcctcttccgagtcaggacgagagggattttaactcgactggcctttcagtttggtgcgttggccgggaaacccgcgactacccctcacacccgagaaccgacttggaggtaaagggatcccctttggaacgtgtgagtgtgtgtgtcggctggcgtctctgttctgagtgtctgttttcggtgatgcgcgctttcggtttgcagctgtcctctaagaccgtaaggactgggggaatcagcagacgtgctaggaggatcacaggctgccaccctgggggacgccccgctgtgggaggtggggagagccagggacgcctggtggtctccttctgtcggtcagaggaccgagttctgttgttgaagcgaaagcttccccctccgcggccgtccgactcttttgcctgcttgtggaagacgcggacgggtcgcgtgtgtctggatctgttggtttctgttttgtgtgtctttgtcttgtgcgtccttgtctacagttttaatatgggacagacggtgacgacccctcttagtttgactctcgaccattggactgaagttaaatccagggctcataatttgtcagttcaggttaagaagggaccttggcagactttctgtgtctctgaatggccgacattcgatgttggatggccatcagaggggacctttaattctgagattatcctggctgttaaagcaattatttttcagactggacccggctctcatcccgatcaggagccctatatccttacgtggcaagatttggcagaggatcctccgccatgggttaaaccttggctgaataagccaagaaagccaggtccccgaattctggctcttggagagaaaaacaaacactcggctgaaaaagtcaagccctctcctcatatctaccccgagattgaggagccgccggcttggccggaaccccaatctgttcccccacccccttatccggcacagggtgctgcgaggggaccctctgcccctcctggagctccggcggtggagggacctgttgcagggactcggacccggaggggcgccaccccggagcggacagacgagatcgcgacattaccgctgcgcacgtacggccctcccataccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaacttggctaaggtaagagaggtgatgcagggaccgaatgaacctccctcagtttttcttgagaggctcatggaagccttcaggcggttcaccccttttgatcctacctcggaggctcagaaagcctcagtggctctggccttcataggacagtcagccctggatatcagaaagaagcttcagagactggaagggttacaggaggctgagttacgtgatctagtgaaggaggcagagaaagtgtattacaaaagggagacagaagaagaaagggaccaaagaaaagagagagaaagagaggaaagggaggaaagacgtaataaacggcaagagaagaatttgactaagatcttggctgcagtggttgaagggaaaagcaatagggaaagagagagagattttaggaaaattaggtcaggccctagacagtcagggaacctgggcaataggaccccactcgacaaggaccaatgtgcatattgtaaagaaaaaggacactgggcaagggactgccccaagaagggaaacaaaggactgaaggtcttagctctggaagaagataaagactagggaagacggggttcggaccccctccccgagcccagggtaactttaaaggtggaggggcaaccagttgagtttctggttgataccggagcgaaacattcagtgctactacagccattaggaaaactaaaagataaaaaatgctgggtgatgggtgccacagggcaacaacaatatccatggactacccgaagaacagttgacttgggagtgggacgggtaacccaatcgttcctgggcatacctgagtgcccagaaccccttttaggtagagacttactgaccacaatgggacgccaaattttttttgaacaagggaccccagaagtgtctgcaaataacaaacctatcactgtgttgaccctccaattagatgacgaatatcgactatattcttccctagtaaagcctgatcaaaatatacaattctggttggaacagtttccccaagcctgggcagaaaccgcagggatgggtttggcaaagcaagttcccccacaggttattcaactgaaagccagtgctgcaccagtgtcagtcagacagtaccccttgagtaaagaagctcgagaaggaattcggccgcatgttcaaagattaatccaacagggcatcctagttcctgtccaatctccctggaatactcccctgctaccggttagaaagcctgggactaatgactatcgaccagtacaggacttgagagaggtcaataaacgggtgcaggatatacacccaacagtcccgaacccttataacctcttgtgtgctctcccgccccaacggagctggtatacagtattggacttaaaggatgccttcttctgcctgagactacatcccactagccaaccactttttgccttcgaatggagagatccaggtgcgggaagaaccgggcagctcacttggactcgactgccccaagggttcaaaaactccccgaccatctttgacgaagccctacacagagacctggccaacttcaggatccaacacccccaggtgaccctcctccagtacgtggatgacctgcttctggcgggagccaccaaacaggactgcttagaaggtacgaaggcactactgctggaattgtctgacctaggctacagagcctccgctaagaaggcccagatttgcaggagagaggtaacatacttggggtacagtttgcggggcgggcagcgatggctgacggaggcacggaagagaactgtagtccagataccggccccaaccacagccaaacaagtgagagagtttttggggacagctggattttgcagactgtggatcccggggtttgcgaccttagcagccccactctacccactaaccaaagaaaaaggggaattctcctgggctcctgagcaccagaaggcatttgatgctatcaaaaaggccctgctgagcgcacctgctctggccctccctgacgtgactaaaccctttaccctttatgtggatgagcgtaagggagtagcccggggagttttaacccaaactctaggaccatggaggagacctgttgcctacctgtcaaagaagctcgatcctgtagccagtggttggcccgtatgcctgaaggctatcgcagctgtggccatactggtcaaggacgctgacaaattgactttgggacagaatataactgtaatagccccccatgcgttggagaacatcgttcggcagcccccagaccgatggatgaccaacgcccgcatgacccactatcaaagcctgcttctcacagagagggtcacgttcgctccaccagccgctctcaaccctgccactcttctgcctgaagagactgatgaaccagtgactcatgattgccatcaactattgattgaggagactggggtccgaaaggaccttacagacataccgctgactggagaagtgttaacctggttcactgacggaagcagctatgtggtgaaaggtaagaggatggctgggccgccggtggtggacgggacccgcacgatctgggccagcagcctgccggaaggaacttcagcacaaaaggctgagctcatggccctcacgcaagctttgcggctggccgaagggaaatccataaacatttatacagacagcaggtatgcctttgcgactgcacacgtacacggggccatctataagcaaagggggttgcttacctcagcagggagggaaataaagaacaaagaggaaattctaagcctattagaagccttacatttgccaaaaaggctagctattatacactgtcctggacatcagaaagccaaagatcccatatccagagggaaccagatggctgaccgggttgccaagcaggcagcccagggtgttaaccttctgcctatgatagaaacacccaaagccccagaacccggacgacagtacaccctagaagactggcaagaaataaaaaagatagaccagttctctgaaactccggaggggacctgctatacctcagatgggaaggaaatcctgccccacaaagaagggttagaatatgtccaacagatacatcgtctaacccacctaggaactaaacacctgcagcagttggtcagaacatccccttatcatgttctgaggctaccaggagtggctgattcggtggtcaaacattgtgtgccctgccagctggttaatgctaatccttccagaatacctccaggaaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaagaaaatactggaggaaatttttccaagatttggaatacctaaggtaatagggtcagacaatggtccagctttcgttgcccaggtaagtcagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggtgaggaacacccctggacagtttgggctgaccccctatgaattgctctacgggggaccccccccgttggcagaaattgcctttgcacatagtgctgatgtgctgctttcccagcctttgttctctaggctcaaggcgctcgagtgggtgaggcagcgagcgtggaagcagctccgggaggcctactcaggaggagacttgcaagttccacatcgcttccaagttggagattcagtctatgttagacgccaccgtgcaggaaacctcgagactcggtggaagggaccttatctcgtacttttgaccacaccaacggctgtgaaagtcgaaggaatccccacctggatccatgcattccacgttaagccggcgccaccttccgattcggggtggaaagcccaaaagactgaaaatccccttaagcttcgcctccatcgcgtggttccttactctgtcaataactcctcaagttaatggtaaacgccttgtggacagcccgaactcccataaacccttatctctcacctggttacttactgactccggtacaggtattaatattaacagcactcaaggggaggctcccttggggacctggtggcccgaattatatgtctgccttcgatcagtaatccctggtctcaatgaccaggccacaccccccgatgtactccgtgcttacgggttttacgtttgcccaggacccccaaataatgaagaatattgtggaaatcctcaggatttcttttgcaagcaatggagctgcgtaacttctaatgatgggaattggaaatggccagtctctcagcaagacagagtaagttactcttttgttaacaatcctaccagttataatcaatttaattatggccatgggagatggaaagattggcaacagcgggtacaaaaagatgtacgaaataagcaaataagctgtcattcgttagacctagattacttaaaaataagtttcactgaaaaaggaaaccaagaaaatattcaaaagtgggtaaatggtatgtcttggggaatagtgtactatggaggctctgggagaaagaaaggatctgttctgactattcgcctcagaatagaaactcagatggaacctccggttgctataggaccaaataagggtttggccgaacaaggacctccaatccaagaacagaggccatctcctaacccctctgattacaatacaacctctggatcagtccccactgagcctaacatcactattaaaacaggggcgaaactttttaacctcatccagggagcttttcaagctcttaactccacgactccagaggctacctcttcttgttggctttgcttagcttcgggcccaccttactatgagggaatggctagaggagggaaattcaatgtgacaaaggaacatagagaccaatgtacatggggatcccaaaataagcttacccttactgaggtttctggaaaaggcacctgcatagggatggttcccccatcccaccaacacctttgtaaccacactgaagcctttaatcgaacctctgagagtcaagtatctggtacctggttatgcaggtggtgggcatgtaatactggattaaccccttgtgtttccaccttggttttcaaccaaactaaagacttttgcgttatggtccaaattgtcccccgggtgtactactatcccgaaaaagcagtccttgatgaatatgactatagatataatcggccaaaaagagagcccatatccctgacactagctgtaatgctcggattgggagtggctgcaggcgtgggaacaggaacggctgccctaatcacaggaccgcaacagctggagaaaggacttagtaacctacatcgaattgtaacggaagatctccaagccctagaaaaatctgtcagtaacctggaggaatccctaacctccttatctgaagtggttctacagaacagaagggggttagatctgttatttctaaaagaaggagggttatgtgtagccttaaaagaggaatgctgcttttatgtggatcattcaggagctatcagggactccatgagcaagctcagagaaaggttagaaaaacgtcacaaagaaaaagaggctggccaaggatggtttgagggatggttcaacaagtccccatgggtgaccaccctgctttctgctctaacaggacccctactaatactgctcctgttgcttacagttgggccttgcttaattaatcggtttgttgcctttgttagagaacaagtgagtgcagttcggatcatggtacttagacagcagtaccaaggccttccaagctaaggagaaactgacctttagccttcctagttctaagattagaactattaacaagagaagaagtggggaatgaaaggatgaaaatgcaacctgactctcccagaacccaggaagttaataagaagctctaaatgccctcgaattccagaccctgttccctataggtaaaagatcatactttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcataagataaaaagaggagaagtcaattgcctaacggaccccagtaagatcgggcgtgccacaaaatgttgaaaatcctgataaatatatcttggtgacaatatgtctcccccacccagagacaggcacaaacatgtaactccagaacaacttaaattaattggtccacaaagcgcgggctctcgaagttttgaattgactggtttgcgatattttaaaaatgattagtttgtaaaagcgcgggvtttgttgtgaaccccataaaagctgtcccgactccacactcggggccgcagtcctctacccctgcgtggcgtacgactgtgggccccagcgcgctcggaataaaaatcctcttgctgtttgcatcaagaccgcttctcgtgagtgatttggggtgtcgcctcttccgagtcaggacgagagggattttaactcgactggcctttcag

SEQ ID NO: 275 - DNA, 8840 bp, artificial
  25811409_B sequence
tgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaattgcttatctggattctgtaaaactgactggcaccatagaagaattgattacacattgacagccctagtgacctatctcaactgcaatctgtcactctgcccaggagcccacgcagatgcggacctccggagctattttaaaatgattggtccacggagcgcgggctctcgatattttaaaatgattggtccacggagcgcgggctctcgatattttaaaatgattggtccacggagcgcgggctctcgatattttaaaatgattggtttgtgacgcacaggctttgttgtgaaccccataaaagctgtcccgattccgcactcagggccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgagggggattgttcttttactggcctttcatttggtgcgttggccgggaaatcctgcgaccaccccttacacccgagaaccgacttggaggtaaagggatcccctttggaacgtgtgtgtgtgtcggccggcgtctctgttctgagtgtctgttttcggtgatgcgcgctttcggtttgcagctgtcctctcagaccgtaaggactggaggactgtgatcagcagacgtgctaggaggatcacaggctgccaccctgggggacgccctgggaggtggggagagccagggacgcctggtggtctcctactgtcggtcagaggaccgagttctgttgttgaagcgaaagcttccccctccgcggccgtccgactcttttgcctgcttgtggaagacgcggacgggtcgcgtgtgtctggatctgttggtttctgtttcgtgtgtctttgtcttgtgcgtccttgtctacagttttaatatgggacagacagtgacgaccccccttagtttgactctcgaccattggactgaagttagatccagggctcataatttgtcagttcaggttaagaagggaccttggcagactttctgtgcctctgaatggccaacattcgatgttggatggccatcagaggggacctttaattctgaaattatcctggctgttaaggcagtcatttttcagactggacccagctctcatcctgatcaggagccctatatccttacgtggcaagatttggcagaagatcctccaccatgggttaaaccatggctaaataaaccaagaaagccaggtccccgaatcctggctcttggagagaaaaacaaacactcggccgaaaaagtcgagccctctcctcgtatctaccccaagatcgaggagccgccgacttggccggaaccccaacctgttcccccacccccttatccagcacagggtgctgtgaggggaccctctgcccctcctggagctccggtggtggagggacctgctgccgggactcggagccggagaggcgccaccccggagcggacagacgagatcgcgacattaccgctgcgcacctatggccctcccatgccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctattgccaggctctggtggcgggtctccggggcgcctcaagacggcccactaatttggctaaggtaagagaggtgatgcagggaccgaacaaacctccctcggtatttcttgagaggctcatggaagccttcaggcggttcaccccttttgatcctacctcggaggcccagaaagcctcagtggccctggccttcattgggcagtcggctctggatatcagaaagaaacttcagagactggaagggttacaggaggctgagttacgtgatctagtgggagaggcagagaaggtgtattacagaagggagacagaagaggagaaggaacagagaaaagaaaaggagagagaagaaagggaggaaagacgtgatagacggcaagagaagaatttgactaagatcttggccgcagtggttgaagggaagagcagcagggagagagagagagattttaggaaaattaggtcaggccctagacagtcagggaacctgggcaataggaccccactcgacaaggaccagtgtgcgtattgtaaagaaaaaggacactgggcaaggaactgccccaagaagggaaacaaaggaccgaaggtcctagctctagaagaagataaagattaggggagacggggttcggaccccctccccgagcccagggtaactttgaaggtggaggggcaaccagttgagttcctggttgataccggagcggagcattcagtgctgctacaaccattaggaaaactaaaagaaaaaaaatcctgggtgatgggtgccacagggcaacggcagtatccatggactacccgaagaaccgttgacttggtagtgggacgggtaacccactcgtttctggtcatccctgagtgcccagtaccccttctaggtagagacttactgaccaagatgggagctcaaatttcttttgaacaaggaagaccagaagtgtctgtggataacaaacccatcactgtgttgaccctccaattagatgatgaatatcgactatattctccccaagtaaagcctgatcaagatatacagtcctggttggagcagtttccccaagcctgggcagaaaccgcagggatgggtttggcaaagcaagttcccccacaggttattcagctgaaggccagtgctacaccagtatcagtcagacagtaccccttgagtagagaggctcgagaaggaatttggccgcatgttcaaagattaatccaacagggcatcctagttcctgtccaatccccttggaatactcccctgctaccggttaggaagcctgggaccaatgattatcgaccagtacaggacttgagagaggtcaataaaagggtgcaggacatacacccaacggtcccgaacccttataacctcttgagcgccctcccgcctgaacggaactggtacacagtattggacttaaaagatgccttcttctgcctgagattacaccccactagccaaccactttttgccttcgaatggagagatccaggtacgggaagaaccgggcagctcacctggacccgactgccccaagggttcaagaactccccgaccatctttgacgaagccctacacagggacctggccaacttcaggatccaacaccctcaggtgaccctcctccagtacgtggatgacctgcttctggcgggagccaccaaacaggactgcttagaaggtacgaaggcactactgctggaattgtctgacctaggctacagagcctctgctaagaaggcccagatttgcaggagagaggtaacatacttggggtacagtttgcggggcgggcagcgatggctgacggaggcacggaagaaaactgtagtccagataccggccccaaccacagccaaacaagtgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccgaggagttttaacccaaaccctaggaccatggaggagacctgttgcctacctgtcaaagaagcttgatcctgtagccagtggttggcccatatgcctgaaggctatcgcagctgtggccatactggtcaaggacgctgacaaattgactttgggacagaatataactgtaatagccccccatgcgttggagaacatcgttcggcagcccccagaccgatggatgaccaacgcccgcatgacccactatcaaagcctgcttctcacagagagggtcacgttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaggatggctggggcggcggtggtggacgggacccgcacgatctaggccagcagcctgccggaaggaacttcagcgcaaaaggctgagctcatggccctcacgcaagctttgcggctggccgaagggaaatccataaacatttatacggacagcaggtatgcctttgcgactgcacacgtacacggggccatctataaacaaagggggttgcttacctcagcagggagggaaataaagaacaaagatgaaattctaagcctattagaagccttacatttgccaaaaaggctagctattatacactgtcctggacatcagaaagccaaagatctcatatctagagggaaccagatggctgaccggattgccaagcaggcagcccaggctgttaaccttctgcctataatagaaacgcccaaagccccagaacccagacgacagtacaccctagaagactggcaagagataaaaaagatagaccagttctctgagactccggaggggacctgctatacctcatatgggaaggaaatcctgccccacaaagaagggttagaatatgtccaacagatacatcgtctcacccacctaggaactaaacacctgtagcagttggtcagaacatccccttatcatgttctgaggctaccaggagtggctgactcggtggtcaaacattgtgtgccctgccagctggttaatgctaatccttccaaagtacctccagggaagagactaagggggagccacccaggcgctcactgggaagtggacttcactaaagtaaagccggctaaatacggaaacaaatacctattggtttttgtagacaccttttcaggatgggtagaggcttatcctactaagaaagagacttcaaccgtggtggctaaaaaaatactggaggaaatttttccgagatttggaatacctaaggtaatcgggtcagacaatggtccagcttttgttgcccaggtaagtcagggactggccaagatattggggattgattggaaactgcattgtgcatacagaccccaaagctcaggacaggtagagaggatgaatagaaccattaaagagaccctcaccaaattgaccacagagactggcattaatgattggatagctctcctgccctttgtgctttttagggttaggaacacccctggacagtttgggctgaccccctatgaattgctctacgggggaccccccccgttggtagaaattgctcctgtacatagtgctgatgtgctgctttcccagcctttgttctctaggctcaaggcgctcgagtgggtgaggcagcgagcgtggaagcagctccgggaggcctactcaggagaaggagacttgcaagttccacatcgcttccaagtgggagattcagtctatgttagacgccaccgtgcaggaaacctcgagactcggtggaagggcccttatctcgtacttttgaccacaccaacggctgtgaaagtcgaaggaatctccacctggatccatgcatcccacgttaagctggcgccacctcccgactcggggtggagagccgaaaagactgagaatccccttaagcttcgcctccatcgcctggttccttactctaacaataactccccaggccagtagtaaacgccttatagacagctcgaacccccatagacctttatcccttacctggctgattattgaccctgatacgggtgtcactgtaaatagcactcgaggtgttgctcctagaggcacctggtggcctgaactgcatttctgcctccgattgattaaccccgctgttaaaagcacacctcccaacctagtccgtagttatgggttctattgctgcccaggcacagagaaagagaaatactgtgggggttctggggaatccttctgtaggagatggagctgcgtcacctccaacaatggagactggaaatggccgatctctctccaggaccgggtaaaattctcctttgtaaattccggcccgggcaagtacaaagtgatgaaactatataaagataagagctgctccccatcagacttagattatctaaagataagtttcactgaaaaaggaaaacaggaaaatattcaaaagtggataaatggtatgagctggggaatagttttttataaatatggcgggggagcagggtccactttaaccattcgccttaggatagagacggggacagaaccccctgtggcagtgggacccgataaagtactggctgaacaggggcccccggccctggagccaccgcataacttgccggtgccccaattaacctcgctgcggcctgacataacacagccgcctagcaacggtaccactggattgattcctaccaacacgcctagaaactccccaggtgttcctgttaagacaggacagagactcttcagtctcatccagggagctttccaagccatcaactccaccgaccctgatgccacttcttcttgttggctttgtctatcctcagggcctccttattatgaggggatggctaaagaaggaaaattcaatgtgaccaaagagcgtagaaatcaatgtacatgggggtcccgaaataagcttaccctcactgaagtttccgggaaggggacatgcataggaaaagctcccccatcccaccaacacctttgctgtagtactgtggtttatgagcaggcctcagaaaatcagtatttagtacctggttataacaggtggtgggcatgcaatactgggttaaccccctgtgtttccacctcagtcttcaaccaatccaaagatttctgtgtcatggtccaaatcgtcccccgagtgtactaccaccctgaggaagtggtccttgatgaatatgactatcggtataaccgaccgaaaagagaacccgtatcccttaccctagctgtaatgctcggattagggacggccgttggcataggaacagggacagctgccctgatcacaggaccacagcagctagagaaaggacttggtgagctacatgcggccatgacagaagatctccgagccttagaggagtctgttagcaacctagaagagtccctgacttctttgtctgaagtggttctacagaaccggaggggattagatctgctgtttctaagagaaggtgggttatgtgcagccttaaaagaagaatgttgcttctatgtagatcactcaggagccatcagagactccatgagcaagcttagagaaaggttagagaggcgtcgaagggaaagagaggctgaccaggggtggtttgaaggatggttcaacaggtctccttggatgaccaccctgctttctgctctgacgggacccctagtagtcctgctcctgttacttacagttgggccttgcttaattaataggtttgttgcctttgttagagaacgagtgagtgcagtccagatcatggtacttaggcaacagtaccaaggccttctgagccaaggagaaactgacctctagccttcccagttctaagattagaactattaacaagacaagaagtggggaatgaaaggatgaaaatgcaacctaaccctcccagaacccaggaagttaataaaaagctctaaatgcccccgaattccagaccctgctggctgccagtaaataggtagaaggtcacacttcctattgttccagggcctgctatcctggcctaagtaagataacaggaaatgagttgactaattgcttatctggattctgtaaaactgactggcaccatagaagaattgattacacattgacagccctagtgacctatctcaactgcaatctgtcactctgcccaggagcccacgcagatgcggacctccggagctattttaaaatgattggtccacggagcgcgggctctcgatattttaaaatgattggtccacggagcgcgggctctcgatattttaaaatgattggtccacggagcgcgggctctcgatattttaaaatgattggtttgtgacgcacaggctttgttgtgaaccccataaaagctgtcccgattccgcactcagggccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgagggggattgttcttttactggcctttca

SEQ ID NO: 276 - DNA, 8899 bp, artificial
  119393850_C sequence
tgaaaggatgaaaatgcaacctaaccctcccagaacccaggaagttaataaaaagctctaaatgcccccgaattccagaccctgctcgctgccagtaaataggtagaaggtcacacttcctattgttctagggcctgctatcctggcctaagtaagataacagggaatgagttgactaattgcttatctggattctgtaaaactgactagcaccatagaagaattgattacacatagaaagccctagtgacctatcttaaatctctgtccagaagcctacgcagatgcggacctccggagctattttaaattgattggtccacggagcgcgggctttcgctattttaaattgattggtccacggagcgcgggctttcgctactttaaattgattggtccacggagcgcgggctttcgctattttaaattgattggtccacggatctcaatattttaaaatgattggtttgcgacgcgcagactttgttgtaaaccccataaaagctgtcccgattccgcactcggggccgcagtcctctacccctgcgtggtgtatgactgtgagccccagcgcgcttggaataaaaatcctcttgctgtttgcatcaagaccgcttctcgtgagtgatttggggtgtcgcctcttccgagcccggacgagggggattgtacatttactggcctttcatttggtgcgttggccgggaagttctgcgactaccccttacacccgagaaccgacttggaggtaaagggatcccctttggaacgtgtgtgtgcgtgtgtcggccggcgtttctgttctgagtgactgttttcggtgctgcgcgctttcggtttgcagctgtcctctcagaccgtaaggactggaggactgtgatcagcagacgtgctaggaggatcacaggctgccgccctgggggacgccccgggaggtggggagagccagggacgcctggtggtctccttctgtcggtcagagggccgagttctgttgttgaagtgaaagcttccccctccgcggccgtccgactcttttgcctgcttgtggaagacgcggacgggtcgcgtgtgtctggatctgttggtttctgtttcgtgtgtctttgtcttgtgcgtccttgtctacagttttaatatgggacagacggtgacgaccccccttagtttgactctcgaccattggactgaagctaaatccagggctcataatttgtcagttcaggttaagaagggaccttggcagactttctgtgcctctgaatggccaacattcgatgttggatggccatcagaggggacctttaattctgaaattattctggctgttaaaacaattatttttcagactggacccggctctcatcctgatcaggagccctatattcttacgtggcaaaatttgacagaagatcctccgccatgggttaaaccatggctaaataaaccaagaaagccaggtccccgaatcctggctcttggagagaaaaacaagcactcggccaaaaaagtcgaaccctctcctcgtatctaccccgagatcgaggagccgccgacttggccggaaccccaacctgttcccccatccccttatccagcacagggtgctgcgaggggaccctccgcccctactggagctccggtggcggagggacctgctgccgggactcgaagccggaggggcgtcaccccggagcggacagacgagatcgtgatattaccgctgcgcacctatggccctcccatgccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaactgaggagcgagagagaattctgttagaggctagaaaaaatgttcctggggccgacgggcgacccacgcagttgcaaaatgagattgacatgggatttcccttgactcgccccagttgggactacaacacggccgaaggtagggagagcttgaaaatctatcgccaggctctggtggcgggtctccggggcgcctcaagacggcccactaatttggctaaggtaagagaggtgatgcagggaccgaacgaacctccctcggtatttcttgagaggctcatggaagccttcaggcggtacaccccttttgatcctacctcggaggcccagaaagcctcagtggccctggccttcatagggcagtcggctctggatatcagaaagaaacttcagagactggaagggttacaggaggctgagttacgtgatctagtgaaagaagcagagaaggtgtattacagaagggagacagaagaggagaaggaacagaggaaagaaaaggagagagaagaaagggaggaaagacgtgatagacggcaagagaagaatttgactaagatcttggccgcagtggttgaagggaagagcagcagggagagagagagagattttaggaaaattaggtcaggccctagacagtcagggaacctgggcaataggaccccactcgacaaggaccagtgtgcgtattgtaaagaaaaaggacactgggcaaggaactgccccaagaagggaaacaaaggaccgaaggtcctagctctggaagaagataaagattaggggagacggggttcggaccccctccccgagcccagggtaactttgaaggtggaggggcaaccagttgagttcctggttgatactggagcagagcattcagtgctgctacaaccattaggaaaactaaaagaaaaaaaatcctgggtgatggatgccacagggcaacggcagtatccatggactacccgaagaaccgttgacttgggagtgggacgggtaacccactcgtttctggtcatccctgagtgcccagtaccccttctgggtagagacttactgaccaagatgggagctcaaatttcttttgaacaaggaagaccagaagtgtctgcgaataacaaacccatcactgtgttgaccccccaattagatgatgaatatagactatattctccccaagtaaagcctgatcaagatatacagtcctggttggagcagtttccccaagcctgggcagaaaccgcagggatgggtttggcaaagcaagttcccccacaggttattcagctgaaggccagtgctacaccagtatcagtcagacagtaccccttgagtagagaggctcgagaaggaatttggccgcatgttcaaagattaatccaacagggcatcctagttcctgtccaatccccttggaatactcccctgctaccggttaggaagcctgggaccaatgattatcgaccagtacaggacttgagagaggtcaataaaagggtgcaggacatacacccaacggtcccgaacccttataacctcttgagcgccctcccgcctgaacggaactggtacacagtattggacttaaaagatgccttcttctgcctgagattacaccccactagccaaccactttttgccttcgaatggagagatccaggtacgggaagaactgggcagctcacctggacccgactgccccaagggttcaagaactccccgaccatctttgatgaagccctacacagagacctggccaacttcaggatccaacacccccaggtgaccctcctccagtacgtggatgacctgcttctggcgggagccaccaaacaggactgctcagaaggtacgaaggcactactgctggaattgtctgacctaggctacagagcctccgctaagaaggcccagatttgcaggagagaggtaacatacttggggtacagtttgcgggacgggcagcgatggctgacggaggcacggaagaaaactgtagtccagataccggccccaaccacagccaaacaagtgagagagtttttggggacagccggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgatgtaactaaaccttttaccctttatgtggatgagcgtaagggagtagcccggggagttttaacccaaaccctaggaccatggagaagacctgttgcctacctgtcaaagaagctcgatcctatagccagtggttggcccgtatgcctgaaggctatcgcagctgtggccatactggtcaaggacgctgacaaattgactttgggacagaatataactataatagccccccatgcattggaaaacatcgtccggcagcccccagaccgatggatgaccaacgctcgcatgacccagtatcaaagcctgcttctcacagagaggatcacgtttgctccaccagccgctctcaaccctgccactcttctgcctgaagagactgatgaaccagtgactcatgattgccatcaactattgatcgaggagactggggtccgcaaggaccttatagacataccgctgactggagaagtgctgacctggttcactgatgggagcagctatgtagtggaaggtaagaggatggctggggcggcagtggtggacggaacccgcacgatctgggccagcagcctgccagaaggaacttcagcgcaaaaggctgagctcatggccctcacgcaagctttgcggctggccgacgggaaatccataaacatttatacggacagcaggtatgcctttgcgactgcacacgtacacggggccatctataagcaaagggggttgcttacctcagcagggagggaaataaagaacaaagaggaaattctaagcctattagaagccttacatttgccaaaaaggctagctattatacactgtcctggacatcagaaagccaaagatcccatatccagagggaaccagatggctgaccgggttgccaagcaggcagcccagggtgttaaccttctgcctataatagaaacacccaaagccccagaacccggacgacagtacaccctagaagactggcaagagataaaaaagatagaccagttctctgaaactccggagaggacctgctatacctcagatgggaaggaaatcctgccccacaaagaagggttagaatatgtccaacagatacatcgtctaacccacctaggaactaaacacctgcagcagttggtcagaacatccccttatcatgttctgaggctaccaggagtggctgactcggtggtcaaacattgtgtgccctgccagctggttaatgctaatccttccagaatacctccaggaaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaagaaaatactggaggaaatttttccaagatttggaatacctaaggtaatagggtcagacaatggtccagctttcgttgcccaggtaagtcagggactggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgccttttagggttaggaacacccctggacagtttgggctgaccccctatgaattgctctacgggggaccccccccgttggcagaaattgcccttgcacatagtgctgatgtgctgctttcccagcctttgttctctaggctcaaggcgctcgagtgggtgaggcagcgagcgtggaagcagctccgggaggcctactcaggaggagacttgcaagttccacatcgcttccaagttggggattcagtctatgttagacgccaccgtgcaggaaacctcgagactcggtggaagggcccttatctcgtacttttgaccacaccaacgactgtgaaagtcgaaggaatccccacctggatccatgcatcccacgttaagccggtgccacctcccgattcggggtggaaagccgaaaagactgaaaatccccttaagcttcgcctccatcgcgtggttccttactctgtcaataactcctcaagttaatggtaaatgccttgtggacagccggaactcccataaacccttatctctcacctggttacttactggctccggtacaggtattaatattaacagcactcaaggggaggctcccttaaggacctggtggcctgagttatatgtctgccttcgatcagtaatccctggtctcaatgaccaggccacaccccccgatgtactccgtgcttacgggttttatgtttgcccaggacccccaaataatgaagaatattgtggaaatcctcaggatttcttttgcaagcaatggagctgcgtaacttctaatgatgggaattggaaatggccagtctctcagcaagacagattaagttactcttttgttaacaatcctaccagttataatcaatttaattatggccatgggagatggaaagattggcaacagcgggtacaaaaagatgtacgaaataagcaaataagctgtcattcgttagacctagattacttaaaaataagtttcactgaaaaaggaaaacaagaaaatattcaaaagtgggtaaatggtatgtcttggggaatagtgtactatggacgctctgggagaaagaaaggatctgttctgactattcgcctcagaatagaaactcagatggaagctccggttgctataggaccaaataagggtttggccaaacaaggacctccaatccaagaacagaggccatctcctaacccctctgattacaatacaacctctggatcagtctccactgagcctaacatcactattaaaacaggggcgaaaccttttagcctcatccagggagcttttcaagctcttaactccacgactccagaggctacctcttcttgttggctttgcttagcttcgggcccaccttactatgagggaatggctagaggagggaaattcaatgtgacaaaggaacatagagaccaatgtacatggggatcccaaaataagcttacccttactgaggtttctggaaaaggcacctgcatagggagggttcccccatcccaccaacacctttgtaaccacactgaagcctttaatcgaacctctgagagtcagtatctggtacctggttatgacaggtggtgggcatgtaatactggattaaccccttgtgtttccaccttggttttcaaccaaactaaagacttttgcgttatggtccaaattgtcccccgggtgtactactatcccgaaaaagcagtccttgatgaatatgactatagatataatcggccaaaaagagagcccatatccctgacactagctgtaatgctcggattgggagtggctgcaggcgtgggtacaggaacggctgccctaatcacaggaccacaacagctggagaaaggacttagtaacctacatcgaattgtaacggaagatctccaagccctagaaaaatctgtcagtaacctggaggaatccctaacctccttatctgaagtggttctacagaacagaagggggttagatctgttatttctaaaagaaggagggttatgtgtagccttaaaagaggaatgctgcttttatgtggatcattcaggagctatcagggactccatgagcaagctcagagaaaggttagaaaaatgtcacaaagaaaaagaggctggccaaggatggtttgagggatggttcaacaagtccccatgggtgaccaccctgctttctgctctaacaggacccctagtaatactgctcctgttgcttacagttgggcctttcttagttaatcggtttgttgcctttgttagagaacaagtgagtgcagttcggatcatggtacttagacagcagtaccaaggccttccaagctaaggaaaaactgacctttagccttcctagttctaagattagaactattaacaagagaagaagtggggaatgaaaggatgaaaatgcaacctgactctcccagaacccaggaagttaataagaagctctaaatgccctcgaattccagaccctgttccctataggtaaaagatcatactttttgctgttttagggcttgctttctgctctgtacaaaactttgtggaaggggaaaaacaggcccctgagtatgtgcctctatgcttgaaacttcttgaaactgctcctaactgcttgtttggcttctgtaagcctgcttgcataagataaaaagaggagaagtcaatcgcctaaccgaccccagtaagatcgggcgtgccacaaaatgttgaaaatcctgataaatatatcttggtgacaatatgtctcccccacccagagacaggcacaaacatgtaactccagaacaacttaaaattaattggtccacaaagcgcgggctctcgaagttttgaattgactgactggtttgcgatattttaaaaatgattagtttgtaaaagcgcgggctttgttgtgaaccccataaaagctgtcccgactccacactcggggccgcagtcctctacccctgcgtggcgtacgactgtgggccccagcgtgctcggaataaaaatcctcttgctgtttgcatcaagactgcttctcgtgagtgatttggggtgtcgcctcttccgagagggattttaactcgactggcccttcag

SEQ ID NO: 277 - DNA, 5895 bp, artificial; identical to SEQ ID NO: 243
  ss21279 sequence

SEQ ID NO: 278 - DNA, 8774 bp, artificial
  300825687_C sequence
acgcgtcgactgaaaggatgaaaatgcaacctaaccctcccagaacccaggaagttaataaaaagctctaaacgcccccgaattccagaccctgctggctgccagtaaataggtagaaggtcacacttcctattgttccagggcctgctatcctggcctaagtaagataacaggaaatgagttgactaatcgcttatctggattctgtaaaactgactggcaccatagaagaattgattacacattgacagccctagtgacctatctcaactgcaatctgtcactctgcccaggagcccacgcagatgcggacctctggagctattttaaaatggttggtccacggagcgcgggctctcgatattttaaaatgattggtccacggagcgcgggctctcgatattttaaaatgattggtttgtgacgcacaggctttgttgtgaaccccataaaagctgtcccgattccgcactcggggccgcagtcctctacccctgcgtggtgtacgactgtgggccccagcgcgcttggaataaaaatcctcttgctgtttgcatcaagaccgcttctcgtgagtgatttggggtgtcgcctcttccgagcccggacgagggggattgttcttttactggcctttcatttggtgcgttggccgggaagtcctgtgaccaccccttacacccgagaaccgacttggaggtaaagggatcccctttggaacgtgtgtgtgtgtcggccggcgtctctgttctgagtgtctgttttcggtgatgcgcgctttcggtttgcagctgtcctctcagaccgtaaggactggaggactgtgatcagcagacgtgctaggaggatcacaggctgccgccctgggggacgccctgggaggtggggagagccagggacgcctggtggtctcctactgtcggtcagaggaccgagttctgttgttgaagcgaaagctttcccctcgcggcgtccgactcttttgcctgcttgtgagacgcgacgggtcgcgtgtgtctggatctgttggtttctgtttcgtgtgtctttgtcttgtgcgtccttgtctacagttttaatatgggacagacagtgacgaccccccttagtttgactctcgaccattggactgaagttagatccagggctcataatttgtcagttcaggttaagaagggaccttggcagactttctgtgcctctgaatggccaacattcgatgttggatggccatcagaggggacctttaattctgaaattatcctggctgttaaagcaatcatttttcagactggacccggctctcatcctgatcaggagccctatatccttacgtggcaagatttggcagaagatcctccgccatgggttaaaccatggctaaataaaccaagaaagccaggtccccgaatcctggctcttggagagaaaaacaaacactcggccgaaaaagtcgagccctctcctcgtatctaccccgagatcgaggagccgccgacttggccggaaccccaacctgttcccccacccccttatccagcacagggtgctgtgaggggaccctctgcccctcctggagctccggtggtggagggacctgctgccgggactcggagccggagaggcgccaccccggagcggacagatgagatcgcgatattaccgctgcgcacctatggccctcccatgccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaactgaggagagagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaatttggctaaggtaagagaggtgatgcagggaccgaacgaacctccctcggtatttcttgagaggctcatggaagccttcaggcggttcaccccttttgatcctacctcggaggcccagaaagcctcagtggccctggccttcattgggcagtcggctctggatatcagaaagaaacttcagagactggaagggttacaggaggctgagttacgtgatctagtgagagaggcagagaaggtgtattacagaagggagacagaagaggagaaggaacagagaaaagaaaaggagagagaagaaagggaggaaagacgtgatagacggcaagagaagaatttgactaagatcttggccgcagtggctgaagggaagagcagcagggagagagagagagattttaggaaaattaggtcaggccctagacagtcagggaacctgggcaataggaccccactcgacaaggaccagtgtgcgtattgtaaagaaaaaggacactgggcaaggaactgccccaagaagggaaacaaaggaccgaaggtcctagctctagaagaagataaagattaggggagacggggttcggaccccctccccgagcccagggtaactttgaaggtggaggggcaaccagttgagttcctggttgataccggagcggagcattcagtgctgctacaaccattaggaaaactaaaagataaaaaatcctgggtgatgggtgccacagggcaacggcagtatccatggactacccgaagaaccgttgacttgggagtgggacgggtaacccacttgtttctggtcatccctgagtgcccaatacccctcctaggtagagacttactgaccaagatgggagctcaaatttcttttgaacaagggaaaccagaagtgtctgcgaataacaaacccatcactgtgttgaccctccaattagatgatgaatatcgactatattctcccctagtaaagcctgatcaaaatatacagtcctggttggagcagtttccccaagcctgggcagaaaccgcagggatgggtttggcaaagcaagttcccccacaggttattcagctgaaggccagtgccacaccaatatcagtcagacagtaccccttgagtagagaggctcgagaagaaatttggccgcatgttcaaagattaatccaacagggcatcctagttcctgtccgatccccttggaatactcccctgctaccagttaggaagcctgggaccaatgattaccgaccagtacaggacttgagagaggtcaataaacgggtgcaggacatacacccaatggtcccgaacccttataacctcttgagcgctctcccacccaaacggaactggtacacagtattggacttaaaaaatgccttcttctgcctgagattacaccccactagccaaccactttttgcctttgagtggagggatccaggtacgggaagaaccggacagctcacctggacccgactgccccaagggttcaaaaactccccgaccatctttgacgaagccctacacagagacctggccaacttcaggatccaacacccccaggtgaccctcctccagtacgtggatgacctgcttctggcgggagccaccaaacaggactgcttagaaggtacgaacgcactactactggaattgtctgacctaggctaccgagcctcagctaaaaaggcccagatttgcaggagagaggtaacatacttggggtacagtctacgggacgggcagcgatggctgacggaggcacggaagagaactgtagtccagatactggccccaaccacagccaagcaagtgagagagtttttggggacagctggattttgcagactgtggatcccgggctttgcgaccttagcagccccactctacccgctaaccaaagaaaaaggggaattctcctgggctcctgagcaccagaaggcatttgatgctatcaaaaaggccctgctgagcgcacctgccctggccctccctgatgtaactaaaccctttaccctttatgtggatgagcataagggggtagcccggggagttttaacccaatccctaggaccatggaggagacctgttgcctacctgtcaaagaagctcgatcctgtagccagtggttggcccgtatgcctgaaggctatcgcagctgtggccatactggtcaaggacgctgacaaatcgactttgggacagaatataactgtaatagccccccatgcgttggagaacatcgtccggcagcccccagaccgatggatgaccaacgcccgcatgacccactatcaaagcctgcttctcacagaaaggatcacgttcgctccacccgccgctctcaaccctgccactcttctgcctgaagagaccgatgaaccagtgactcatgattgccatcaactgttgatcgaggagactggggtccgcaaggaccttacagacataccgctgactggagaagtgctgacctggttcactgatgggagcagctatgtagtggaaggtaagaggatggctagggcggcggtggtggacgggacccgcactatctgggccagcagcctgtcggaagggacttcagcacaaaaggctgaactcgtggccctcacacaagctttgcggctggccgaggggaaatccataaacatttatacggacagcaggtatgcctttgcgactgcacacgtgcatggggccatctataaacaaagggggttgcttacctcagcagggagggaagtcaagaacaaagaaaaaattctaagcttgttggaggccttacatttgccaaaaaggctagccattatacattgccctggacatcagaaagccaaagatctcatatccagagggaaccagatggctgaccgggttgccaagcaggcagcccagggtgttaaccttctgcctataatagaaacgcccaaagccccagaacccagacgacagtacaccctagaagactggcaagagataaaaaagatagaccagttctctgagactccggaggggacctgctatacctcagatgggaaggaaatcctgccccacaaagaagggttagaatatgtccaacagatacatcatctaacccacctaggaactaaacacctgcagcagttggtcagaacatccccttatcatgttctgaggctaccaggagtggctgactcggtggtcaaacattgtgtgccctgccagctggttaatgataatccttccagaatacctccaggaaagagactaaggggaagccacccaggcgctcactgggaagtggacttcactgaggtaaagccggctaaatacggaaacaaatatctattggtttttgtagataccttttcaggatgggtagaggcttatcctactaagaaaaagacttcaaccgtggtggctaaaaaaatactggaggaaatttttccgagatttggaatacctaaggtaatcgggtcagacaatggtccagctttcgttgcccaggtaagtcagggattggccaagatattggggattgattggaaactgcattgtgcatacagaccccaaagctcaggacaggtagagaggatgaatagaaccattaaagagacccttaccaaattgaccacagagactggcattaatgattggatagctctcctgccctttgtgctttttagggttaggaacacccctggacagtttgggctgaccccctatgaattgctctacgggggaccccccccgttggtagaaattgcctctgtacatagtgctgatgtgctgctttcccagcctttgttctctaggctcaaggcgctcgagtgggtgaggcaacgagcgtggaagcagctccgggaggcctactcaggagaaggagacttacaagttccacatcactaccaagtgggagattcagtctatgttagacggcaccgtgcaggaaacctcgagactcggtggaagggcccttatctcgtacttttgaccacaccaacggctgtgaaagtcgaaggaatctccacctggatccatgcatcccacgttaagctggcgccacctcccgactcggggtggagagccgaaaagactgagaatccccttaagcttcgcctccatcgcatggttccttactctgtcaataactcctcaagttaatggtaaacgccttgtggacagcccgaactcccataaacccttatctctcacctggttacttactgactctggtacaggtattaatattaacagcactcaaggggaggctcccttagggacctggtggcctgaattatatgtctgccttcgatcagtaatccctggcctcaatgaccaggccacaccccccgatgtactccgtgcttacgggttttatgtttgcccaggacccccaaataatgaagaatattgtggaaatcctcaggatttcttttgcaagcaatggagctgcgtaacttctaatgatgggaattggaaatggccagtctctcagcaagacagagtaagttactcttttgttaacaatcctaccagttataatcaatttaattatggccatgggagatggaaagattggcaacagcgggtacaaaaagatgtacgaaataagcaaataagctgtcattcgttagacctagattacttaaaaataagtttcactgaaaaaggaaaacaagaaaatattcaaaagtgggtaaatggtatatcttggggaatagtgtactatggaggccctgggagaaagaaaggatctgttctgactattcgcctcagaatagaaactcagatggaacctccggttgctataggaccaaataagggtttggccgaacaaggacctccaatccaagaacagaggccatctcctaacccctctgattacaatacaacctctggatcagtccccactgagcctaacatcactattaaaacaggggcgaaactttttagcctcatccagggagcttttcaagctcttaactccacgactccagaggctacctcttcttgttggctttgcttagcttcgggcccaccttactatgagggaatggctagaggagggaaattcaatgtgacaaaggaacatagagaccaatgtacatggggatcccaaaataagcttacccttactgaggtttctggaaaaggcacctgcatagggatggttcccccatcccaccaacacctttgtaaccacactgaagcctttaatcgaacctctgagagtcaatatctggtacctggttatgacaggtggtgggcatgtaatactggattaaccccttgtgtttccaccttggttttcaaccaaactaaagacttttgcgttatggtccaaattgtcccccgggtgtactactatcccgaaaaagcagtccttgatgaatatgactatagatataatcggccaaaaagagagcccatatccctgacactagctgtaatgctcggattgggagtggctgcaggcgtgggaacaggaacggctgccctaatcacaggaccgcaacagctggagaaaggacttagtaacctacatcgaattgtaacggaagatctccaagccctagaaaaatctgtcagtaacctggaggaatccctaacctccttatctgaagtggttctacagaacagaagggggttagatctgttatttctaaaagaaggagggttatgtgtagccttaaaagaggaatgctgcttttatgtggatcattcaggagctatcagggactccatgagcaagctcagagaaaggttagaaaaacgtcacaaagaaaaagaggctggccaaggatggtttgagggatggttcaacaagtccccatgggtgaccaccctgctttctgctctaacaggacccctagtaatactgctcctgttgcttacagttgggccttgcttaattaatcggtttgttgcctttgttagagaacaagtgagtgcagttcggatcatggtacttagacagcagtaccaaggccttccaagctaaggagaaactgacctttagccttcctagttctaagattagaactattaacgagagaagaagtggggaatgaaaggatgaaaatgcaacctgactctcccagaacccaggaagttaataagaagctctaaatgccctcgaattccagaccctgttccctataggtaaaagatcatactttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcataagataaaaagaggagaagtcaattgcctaacggaccccagtaaggtcgggcgtgccacaaaatgttgaaaatcctgataaatatatcttggtgacaatatgtctcccccacccagagacaggcacaaacatgtaactccagaacaacttaaaattaattggtccacaaagcgcgggctctcgaagttttgaattgactggtttgcgatattttaaaaatgattagtttgtaaaagcgcgggctttgttgtgaaccccataaaagctgtcccgactccacactcggggccgcagtcctctacccctgcgtggcgtacgactgtgggccccagcgcgctcggaataaaaatcctcttgctgtttgcatcagtaaa

SEQ ID NO: 279 - DNA, 8188 bp, artificial
  50429161_AC sequence
gccgcagtcctctacccctgcgtggtgtacgactgtgggccccaagcgcgcttggaataaaaattctcttgctgattgcatcaagaccgcttctcgtgagtgattaaggggagtcgccttttccgagcctggaggttctttttgctggtcttacatttgggggctcgtccgggatctgtcgcggccacccctaacacccgagaaccgacttggaggtaaaaaggatcctctttttaacgtgtatgcatgtaccggccggcgtctctgttctgagtgtctgttttcagtggtgcgcgctttcggtttgcagctgtcctctcaggccgtaagggctgggggactgtgatcagcagacgtgctaggaggatcacaggctgctgccctgggggacgccccgggaggtgaggagagccagggacgcctggtggtctcctactgtcggtcagaggaccgaattctgttgctgaagcgaaagcttccccctccgcgaccgtccgactcttttgcctgcttgtggaagacgtggacgggtcacgtgtgtctggatctgttggtttctgttttgtgtgtctttgtcttgtgtgtccttgtctacagttttaatatgggacagacggtgacgacccctcttagtttgactctcgaccattggactgaagttaaatccagggctcataatttgtcagttcaggttaagaagggaccttggcagactttctgtgtctctgaatggccgacattcgatgttggatggccatcagaggggacctttaattctgagattatcctggctgttaaagcaattatttttcagactggacccggctctcatcccgatcaggagccctatatccttacgtggcaagatttggcagaggatcctccgccatgggttaaaccatggctgaataagccaagaaagccaggtccccgaattctggctcttggagagaaaaacaaacactcggctgaaaaagtcaagccctctcctcatatctaccccgagattgaggagccaccggcttggccggaaccccaatctgttcccccacccccttatctggcacagggtgccgcgaggggaccctttgcccctcctggagctccggcggtggagggacctgctgcagggactcggagccggaggggcgccaccccggagcggacagacgagatcgcgacattaccgctgcgcacgtacggccctcccacaccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctattagaggctagaaaaaatgttcctggggccgacgggcgacccacgcagttgcaaaatgagattgacatgggatttcccttaactcgccccggttgggactacaacacggctgaaggtagggagagcttgaaaatctatcgccaggctctggtggcgggtctccggggcgcctcaagacggcccactaatttggctaaggtaagagaagtgatgcagggaccgaatgaacccccctctgtttttcttgagaggctcttggaagccttcaggcggtacaccccttttgatcccacctcagaggcccaaaaagcctcagtggctttggcctttataggacagtcagccttggatattagaaagaagcttcagagactggaagggttacaggaggctgagttacgtgatctagtgaaggaggcagagaaagtatattacaaaagggagacagaagaagaaagggaacaaagaaaagagagagaaagagaggaaagggaggaaagacgtaataaacggcaagagaagaatttgactaagatcttggctgcagtggttgaagggaaaagcaatacggaaagagagagagattttaggaaaattaggtcaggccctagacagtcagggaacctgggcaataggaccccactcgacaaggaccaatgtgcatattgtaaagaaagaggacactgggcaaggaactgccccaagaagggaaacaaaggaccaaggatcctagctctagaagaagataaagattaggggagacggggttcggaccccctccccgagcccagggtaactttgaaggtggaggggcaaccagttgagttcctggttgataccggagcgaaacattcagtgctactacagccattaggaaaactaaaagataaaaaatcctgggtgatgggtgccacagggcaacaacagtattcatggactacccgaagaacagttgacttgggagtgggacgggtaacccactcgtttctggtcatacctgagtgcccagcacccctcttaggtagagacttattgaccaagatgggagcacaaatttcttttgaacaagggaaaccagaagtgtctgcaaataacaaacctatcactgtgttgaccctccaattagatgacgaatatcgactatactctcccctagtaaagcctgatcaaaatatacaattctggttggaacagtttccccaagcctgggcagaaaccgcagggatgggtttggcaaagcaagttcccccacaagttattcaactgaaggccagtgccacaccagtgtcagtcagacagtaccccttgagtaaagaagctcaagaaggaattcggccgcatgtccaaagattaatccaacagggcatcctagttcctgtccaatctccctggaatactcccctgctaccggttagaaagcctgggactaatgactatcgaccagtacaggacttgagagaggtcaataaacgggtgcaggatatacacccaacagtcccgaacccttataacctcttgtgtgctctcccaccccaacggagctggtatacagtattggacttaaaggatgcctttttctgcctgagattacaccccactagccaaccactttttgccttcgaatggagagatccaggtacgggaagaaccgggcagctcacctggacccgactgccccaagggttcaagaactccccgaccatctttgacgaagccctacacagagacctggccaacttcaggatccaacaccctcaggtgaccctcctccagtacgtggatgacctgcttctggcgggagccaccaaacaggactgcttagaaggcacgaaggcactactgctggaattgtctgacctaggctacagagcctctgctaagaaggcccagatttgcaggagagaggtaacatacttggggtacagtttgcgggacgggcagcgatggctgacggaggcacggaagaaaactgtagtccagataccggccccaaccacagccaaacaaatgagagagtttttggggacagctggattttgcagactgtggatcccggggtttgcgaccttagcagccccactctacccgctaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccggggagttttaacccaaaccctaggaccatggagaagacctgtcgcctacctgtcaaagaagctcgatcctgtagccagtggttggcccatatgcctgaaggctatcgcagctgtggccatactggtcaaggacgctgacaaattgactttgggacagaatataactgtaatagccccccatgcattggagaacatcgttcggcagcccccagaccgatggatgaccaacgcccgcatgacccactatcaaagcctgcttctcacagagagggtcacgttcgctccaccagccgctctcaaccctgccactcttctgcctgaagagactgatgaaccagtgactcatgattgccatcaactattgattgaggagactggggtccgcaaggaccttacagacataccgctgactggagaagtgctaacctggttcactgacggaagcagctatgtggtggaaggtaagaggatggctggggcggcggtggtggacgggacccgcacgatctgggccagcagcctgccggaaggaacttcagcacaaaaggctgagctcatggccctcacgcaagctttgcggctggccgaagggaaatccataaacatttatacggacagcaggtatgcctttgcgactgcacacgtacatggggccatctataaacaaagggggttgcttacctcagcagggagggaaataaagaacaaagaggaaattctaagcctattagaagccgtacatttaccgaaaaggctagctattatacactgtcctggacatcagaaagctaaagatctcatatccagaggaaaccagatggctgaccgggttgccaagcaggcagcccagggtgttaaccttctgcctataatagaaatgcccaaagccccagaacccagacgacagtacaccctagaagactggcaagagataaaaaagatagaccagttctctgagactccggaagggacctgctatacctcagatgggaaggaaatcctgccccacaaagaagggttagaatatgtccaacagatacatcgtctaacccacctaggaactaaacacctgcagcagttggtcagaacatccccttatcatgttctgaggctaccaggagtggctgactcggtggtcaaacattgtgtgccctgccagctggttaatgctaatccttccagaatgcctccagggaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaagaaaatactggaggaaatttttccaagatttggaatacctaaggtaatagggtcagacaatggtccagcttttgttgcccaggtaagtcagggactggccaagatattggggattgattggaaactgcattgtgcatacagaccccaaagctcaggacaggtagagaggatgaatagaaccattaaagagacccttactaaattgaccgcggagactggcgttaatgattggatagctctcctgccctttgtgctttttagggttaggaacacccctggacagtttgggctgaccccctatgaattactctacgggggaccccccccattggtagaaattgcttctgtacatagtgctgatgtgctgctttcccagcctttgttctctaggctcaaggcgctcgagtgggtgaggcagcgagcgtggaagcagctccgggaggcctactcaggaggagacttgcaagttccacatcgcttccaagttggagattcagtctatgttagacgccaccgtgcaggaaacctcgagactcggtggaagggaccttatctcgtacttttgaccacaccaacggctgtgaaagtcgaaggaatccccacctggatccatgcatcccacgttaagccggcgccacctcccgattcggggtggaaagccgaaaagactgaaaatccccttaagcttcgcctccatcgcgtggttccttactctgtcaataactcctcaagttaatggtaaacgccttgtgaacagtccgaactcccataaacccttatctctcacctggttacttactgactccggtacaggtattaatattaacagcactcaaggggaggctcccttggggacctggtggcctgaattatatgtctgccttcgatcagtaatccctggtctcaatgaccaggccacaccccccgatgtactccgtgcttacgggttttacgtttgcccaggacccccaaataatgaagaatattgtggaaatcctcaggatttcttttgcaagcaatggagctgcgtaacttctaatgatgggaattggaaatggccagtctctcagcaagacagagtaagttactcttttgttaacaatcctaccagttataatcaatttaattatggccatgggagatggaaagattggcaacagcgggtacaaaaagatgtacgaaataagcaaataagctgtcattcgttagacctagattacttaaaaataagtttcactgaaaaaggaaaacaagaaaatatcctaaaatgggtaaatggtatgtcttggggaatggtatattacggaggctcgggtaaacaaccaggctccattctaactattcgcctcaaaataaaccagctggagcctccaatggctataggaccaaatacggtcttgacgggtcaaagacccccaacccaaggaccaggaccatcctctaacataacttctggatcagaccccactgagtctaacagcacgactaaaatgggggcaaaactttttagcctcatccagggagcttttcaagctcttaactccacgactccagaggctacctcttcttgttggctatgcttagctttgggcccaccttactatgaaggaatggctagaagagggaaattcaatgtgacaaaagaacatagagaccaatgcacatggggatcccaaaataagcttacccttactgaggtttctggaaaaggcacctgcataggaaaggttcccccatcccaccaacacctttgtaaccacactgaagcctttaatcaaacctctgagagtcaatatctggtacctggttatgacaggtggtgggcatgtaatactggattaaccccttgtgtttccactttggtttttaaccaaactaaagatttttgcattatggtccaaattgttccccgagtgtattactatcccgaaaaagcaatccttgatgaatatgactacagaaatcatcgacaaaagagagaacccatatctctgacacttgctgtgatgctcggacttggagtggcagcaggtgtaggaacaggaacagctgccctggtcacgggaccacagcagctagaaacaggacttagtaacctacatcgaattgtaacagaagatctccaagccctagaaaaatctgtcagtaacctagaggaatccctaacctccttatctgaagtagtcctacagaatagaagagggttagatttattatttctaaaagaaggaggattatgtgtagccttgaaggaggaatgctgtttttatgtggatcattcaggggccatcagagactccatgagcaagcttagagaaaggttggagaagcgtcgaagggaaaaggaaactactcaagggtggtttgagggatggttcaacaggtctccttggttggctaccctactttctgctttaacaggacccttaatagtcctcctcctgttactcacagttgggccatgtattattaacaagttaattgccttcattagagaacgaataagtgcagtccagatcatggtacttagacaacagtaccaaagcccgtctagcagggaagctggccgctagctctaccagttctaagattagaactattaacaagagaagaagtggggaatgaaaggatgaaaatacaacctaagctaatgagaagcttaaaattgttctgaattccagagtttgttccttataggtaaaagattaggttttttgctgttttaaaatatgcggaagtaaaataggccctgagtacatgtctctaggcatgaaacttcttgaaactatttgagataacaagaaaagggagtttctaactgcttgtttagcttctgtaaaactggttgcgccataaagatgttgaaatgttgatacacatatcttggtgacaacatgtctcccccaccccgaaacatgcgcaaatgtgtaactccaaaacaatttaaattaattggtccacgaagcgcgggctctcgaagttttaaattgactggtttgtaatattttgaaatgattggtttgtaaagcgcgggctttgttgtgaaccccataaaagctgtcccgactccacactcggggccgcagtcctctacccctgcgtggtgtacgactgtgggccccaagcgcgcttggaataaaaattctcttgctgattgcatcaa

SEQ ID NO: 280 - DNA, 8305 bp, artificial
  63054320_AC sequence
gcgtggtgtacgactgtgggccccagcgcgcttggaataaaaatcctcttgctgtttgcatcaagaccgcttctcgtgagtgattaaggggagtcgccttttccgagcctggaggttctttttgctagtcttacatttgggggctcgtccgggatctgtcgcggccacccctaacacccgagaaccgacttggaggtaaaaaggatcctctttttaacgtgtatgcatgtaccggccggcgtctctgttctgagtgtctgttttcagtggtgcgcgctttcggtttgcagctgtcctctcagaccgtaaggactgggggactgtgatcagcagacgtgctaggaggatcacaggctgccaccctgggggacgccccgggaggtgaggagagccagggacgcctggtggtctccttctgtcggtcagaggaccgagttctgttgttgaagcgaaagcttccccctccgcggccgtccgactcttttgcctgcttgtggaagacgcggacgggtcgcgtgtgtctggatctgttggtttctgttttgtgtgtctttgtcttgtgcgtccttgtctacagttttaatatgggacagacggtgacgacccctcttagtttgactctcgaccattggactgaagttaaatccagggctcataatttgtcagttcaggttaagaagggaccttggcagactttctgtgtctctgaatggccgacattcgatgttggatggccatcagaggggacctttaattctgagattatcctggctgttaaagcaattatttttcagactggacccggctctcatcccaatcaggagccctatatccttacgtggcaagatttggcagaggatcctccgccatgggttaaaccttggctgaataagccaagaaagccaggtccccgaattctggctcttggagagaaaaacaaacactcggctgaaaaagtcaagccctctcctcatatctaccccgagattgaggagccgccggcttggccggaaccccaatctgttcccccacccccttatctggcacagggtgctgcgaggggaccctctgcccctcctggagctccggcggtggagggacctgctgcagggactcggagccggaggggcgccaccccggagcggacagacgagatcgcgacattaccgctgcgcacgtacggccctcccacaccggggggccaattgcagcccctccagtattggcccttttcttctgcagatctctataattggaaaactaaccatccccctttctcggaggatccccaacgcctcacggggttggtggagtcccttatgttctctcaccagcctacttgggatgattgtcaacagctgctgcagacactcttcacaaccgaggagcgagagagaattctgttagaggctagaaaaaatgttcctggggccgacgggcgacccacgcagttgcaaaatgagattgacatgggatttcccttgactcgccccggttgggactacaacacggctgaaggtagggagagcttgaaaatctatcgccaggctctggtggcgggtctccggggcgcctcaagacggcccactaatttggctaaggtaagagaagtgatgcagggaccgaatgaacccccctctgttttccttgagtggctcttggaagccttcaggcggtacaccccttttgatcccacctcagaggcccaaaaagcctcagtggctttggcctttataggacagtcagccttggatattagaaagaagcttcagagactggaagggttacaggaggctgagttacgtgatctagtgaaggaggcagagaaagtatattacaaaagggagacagaagaagaaagggaacaaagaaaagagagagaaagagaggaaagggaggaaagacgtaataaacggcaagagaagaatttgactaagatcttggctgcagtggttgaagggaaaagcaatacggaaagagagagagattttaggaaaattaggtcaggccctagacagtcagggaacctgggcaataggaccccactcgacaaggaccaatgtgcatattgtaaagaaaaaggacactgggcaaggaactgccccaagaagggaaacaaaggactgaaggtcttagctctagaagaagataaagactagggaagacggggttcggaccccctccccgagcccagggtaactttgaaggtggaggggcaaccagttgagttcctggttgataccggagcgaaacattcagtgctactacagccattaggaaaactaaaagataaaaaatcctgggtgatgggtgccacagggcaacaacagtatccatggactacccgaagaacagttgacttgggagtgggacgggtaacccactcgtttctggtcatacctgagtgcccagcacccctcttaggtagagacttattgaccaagatgggagcacaaatttcctttgaacaagggaaaccagaagtgtctgcaaataacaaacctatcactgtgttgaccctccaattagatgacgaatatcgactatactctcccctagtaaagcctgatcaaaatatacaattctggttggaacagtttccccaagcctgggcagaaaccgcagggatgggtttggcaaagcaagttcccccacaagttattcaactgaaggccagtgccacaccagtgtcagtcagacagtaccccttgagtaaagaagctcaagaaggaattcggccgcatgtccaaagattaatccaacagggcatcctagttcctgtccaatctccctggaatactcccctgctaccggttagaaagcctgggactaatgactatcgaccagtacaggacttgagagaggtcaataaacgggtgcaggatatacacccaacagtcccgaacccttataacctcttgtgtgctctcccaccccaacggagctggtatacagtattggacttaaaggatgcctttttctgcctgagattacaccccactagccaaccactttttgccttcgaatggagagatccaggtacgggaagaaccgggcagctcacctggacccgactgccccaagggttcaagaactccccgaccatctttgacgaagccctacacagagacctggccaacttcaggatccaacaccctcaggtgaccctcctccagtacgtggatgacctgcttctggcgggagccaccaaacaggactgcttagaaggcacgaaggcactactgctggaattgtctgacctaggctacagagcctctgctaagaaggcccagatttgcaggagagaggtaacatacttggggtacagtttgcgggacgggcagcgatggctgacggaggcacggaagaaaactgtagtccagataccggccccaaccacagccaaacaagtgagagagtttttggggacagctggattttgcagactgtggatcccggggtttgcgaccttagcagccccactctacccactaaccaaagaaaaaggggaattctcctgggctcctgagcaccagaaggcatttgatgctatcaaaaaggccctgctgagcgcacctgctctggccctccctgacgtaactaaaccctttaccctttatgtggatgagcgtaagggagtagcccggggagttttaacccaaaccctaggaccatggaggagacctgttgcctacctgtcaaagaagctcgatcctgtagccagtggttggcccgtatgcctgaaggctatcgcagctgtggccatactggtcaaggacgctgacaaattgactttgggacagaatataactgtaatagccccccatgcgttggagaacatcgttcggcagcccccagaccgatggatgaccaacgcccgcatgacccactatcaaagcctgcttctcacagagagggtcacgttcgctccaccagccgctctcaaccctgccactcttctgcctgaagagactgatgaaccagtgactcatgattgccatcaactattgattgaggagactggggtccgcaaggaccttacagacataccgctgactggagaagtgttaacctggttcactgacggaagcagctatgtggtggaaggtaagaggatggctggggcggcggtggtggacgggacccgcacgatctgggccagcagcctgccggaaggaacttcagcacaaaaggctgagctcatggccctcacgcaagctttgcggctggccgaagggaaatccataaacatttatacagacagcaggtatgcctttgcgactgcacacgtacacggggccatctataagcaaagggggttgcttacctcagcagggagggaaataaagaacaaagaggaaattctaagcctattagaagccttacatttgccaaaaaggctagctattatacactgtcctggacatcagaaagccaaagatcccatatccagagggaaccagatggctgaccgggttgccaagcaggcagcccagggtgttaaccttctgcctatgatagaaacacccaaagccccagaacccggacgacagtacaccctagaagactggcaagagataaaaaagatagaccagttctctgagactccggaagggacctgctatacctcagatgggaaggaaatcctgccccacaaagaagggttagaatatgtccaacagatacatcgtctaacccacctaggaactaaacacctgcagcagttggtcagaacatctccttatcatgttctgaggctaccaggagtggctgattcggtggtcaaacactgtgtgccctgccagctggttaatgctaatccttccagaatacctccaggaaagagactaaggggaagccacccaggcgctcactgggaagtggacttcactgaggtaaagccggctaaatacggaaacaaatatctattggtttttgtagacaccttttcaggatgggtagaggcttatcctactaagaaagagacttcaaccgtggtggctaagaaaatactggaggaaatttttccaagatttggaatacctaaggtaatagggtcagacaatggtccagctttcgttgcccaggtaagtcagggactggccaagatattggggattgattggaaactgcattgtgcatacagaccccaaagctcaggacaggtagagaggatgaatagaaccattaaagagacccttactaaattgaccgcggagactggcgttaatgattggatagctctcctgccctttgtgctttttagggttaggaacacccctggacagtttgggctgaccccctatgaattactctacgggggaccccccccattggtagaaattgcttccgtacatagtgctgacgtgctgctttcccagcctttgttctctaggctcaaggcacttgagtgggtgagacaacgagcgtggaggcaactccgggaggcctactcaggaggaggagacttgcagatcccacatcgtttccaagtgggagattcagtctacgttagacgccaccgtgcaggaaacctcgagactcggtggaagggcccttatcacgtacttttgaccacaccaacggctgtgaaagtcgaaggaatctccacctggatccatgcatcccacgttaagccggcgccacctcccgattcggggtggaaagccgaaaagactgaaaatccccttaagcttcgcctccatcgcgtggttccttactctgtcaataacttctcaagttaatggtaaacgccttgtggacagcccgaactcccataaacccttatctctcacctggttacttactgactccggtacaggtattaatattaacagcactcaaggggaggctcccttggggacctggtggcctgaattatatgtctgccttcgatcagtaatccctggtctcaatgaccaggccacaccccccgatgtactccgtgcttacgggttttacgtttgcccaggacccccaaataatgaagaatattgtggaaatcctcaggatttcttttgcaagcaatggagctgcgtaacttctaatgatgggaattggaaatggccagtctctcagcaagacagagtaagttactcttttgttaacaatcctaccagttataatcaatttaattatggccatgggagatggaaagattggcaacagcgggtacaaaaagatgtacgaaataagcaaataagctgtcattcgttagacctagattacttaaaaataagtttcactgaaaaaggaaaacaagaaaatattcaaaagtgggtaaatggtatgtcttggggaatagtgtactatggaggctctgggagaaagaaaggatctgttctgactattcgcctcagaatagaaactcagatggaacctccggttgctataggaccaaataagggtttggccgaacaaggacctccaatccaagaacagaggccatctcctaacccctctgattacaatacaacctctagatcagtccccactgagcctaacatcactattaaaacaggggcgaaactttttaacctcatccagggagcttttcaagctcttaactccacgactccagaggctacctcttcttgttggctttgcttagcttcgggcccaccttactatgagggaatggctagaggagggaaattcaatgtgacaaaggaacatagagaccaatgtacatggggatcccaaaataagcttacccttactgaggtttctggaaaaggcacctgcatagggatggttcccccatcccaccaacacctttgtaaccacactgaagcctttaatcgaacctctgagagtcagtatctggtacctggttatgacgggtggtgggcatgtaatactggattaaccccttgtgtttccaccttggttttcaaccaaactaaagacttttgcgttatggtccaaattgtcccccgggtgtactactatcccgaaaaagcagtccttgatgaatatgactatagatataatcggccaaaaagagagcccatatccctgacactagctgtaatgctcggattgggagtggctgcaggcgtgggaacaggaacggctgccctaatcacaggaccgcaacagctggagaaaggacttagtaacctacatcgaattgtaacggaagatctccaagccctagaaaaatctgtcagtaacctggaggaatccctaacctccttatctgaagtggttctacagaacagaagggggttagatctgttatttctaaaagaaggaggattatgtgtagccttgaaggaggaatgctgtttttatgtggatcattcaggggccatcagagactccatgaacaagcttagagaaaggttggagaagcgtcgaagggaaaaggaaactactcaagggtggttcgagggatggttcaacaggtctccttggttggctaccctactttctgctttaacaggacccttaatagtcctcctcctgttactcacagttgggccatgtattattaacaagttaattgccttcattagagaacgaataagtgcagtccagatcatggtacttagacaacagtaccaaagcccgtctagcagagaagctggccgctagctctaccagttctaagattagaactattaacaagagaagaagtggggaatgaaaggatgaaaatgcaacctgactctcccagaacccaggaagttaataagaagctctaaatgccctcgaattccagaccctgttccctataggtaaaagatcatactttttgctgttttagggcttgctttctgctctgtacaaaactttgtggaaggggaaaaacaggcccctgagtatgtgcctctatgcttgaaacttcttgaaactgctcctaactgcttgtttggcttctgtaaacctgcttgcataagataaaaagaggagaagtcaattgcctaacggaccccagtaagatcgggtgtaccacaaaatgttgaaacacatatcttggtgacaacatgtctcccccaccccgaaacatgcgcaaatgtgtaactctaaaacaatttaaattaattggtccacgaagcgcgggctttatattttgaaatgattggcttgtaaagcgcgggctttgtattttgaaatgattggtttgtaaagcgcgggctttatattttgaaatgattggtttgtaaagcgcgggctttgttgtgaaccccataaaagctgtcccgactccacactcggggtcgcagtcctctacccctgcgtggtgtacgactgtgggccccagcgcgcttggaataaaaatcctcttgctgtttgcatc

What is claimed is:

1. A method of inactivating expression of at least 20% of the copies of an endogenous retroviral target gene in a cell comprising multiple copies of the gene, comprising:
   (a) introducing into the cell (i) one or more guide ribonucleic acid (gRNA) sequences that comprise a portion that is complementary to a portion of the endogenous retroviral target gene, and (ii) a nucleic acid sequence that encodes a Cas protein; and
   (b) maintaining the cells under conditions in which (i) the Cas protein is expressed, (ii) the Cas protein and gRNAs form co-localization complexes with a plurality of the copies of the endogenous retroviral target gene, and (iii) the Cas protein cuts at least 20% of the copies of the endogenous retroviral target gene, thereby inactivating expression of said copies.

2. The method of claim 1, wherein the cell is a stem cell, zygote, or a germ line cell.

3. The method of claim 1, wherein the cell is a porcine cell.

4. The method of claim 1, wherein the endogenous retroviral target gene is a porcine endogenous retrovirus (PERV) gene.

5. The method of claim 4, wherein the PERV gene comprises a pol gene.

6. The method of claim 5, wherein all copies of the pol gene in the cell are inactivated.

7. The method of claim 1, wherein the Cas protein is a Cas9.

8. The method of claim 1, wherein the one or more gRNA sequences are about 10 to about 1000 nucleotides.

* * * * *